United States Patent 7,745,391 (HUMAN THROMBOSPONDIN POLYPEPTIDE) - sequence listing, part 271

SEQ ID NO: 800340 - protein, 721 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 800341 - protein, 302 aa, Homo sapiens
MARYEAGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKYDGFYSWDPGGGTIWG

SEQ ID NO: 800342 - protein, 746 aa, Homo sapiens
SPPPPPPPPPPPPPPSPLPPSVRYEAGCFVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 800343 - protein, 708 aa, Homo sapiens
MNIKGRNLFIFELARYSKITLFGNTNRGVKIVAVGYPKGFETSSFFSSCILQVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 800344 - protein, 629 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPVSKDWS

SEQ ID NO: 800345 - protein, 776 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVRPDLYCAQALNCMAVTLSQKGHYFHPYSCLKKLLSLSGCTFPPHPNGSVFFFPLVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 800346 - protein, 583 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLNC

SEQ ID NO: 800347 - protein, 384 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVITWCWTRPTCGRVFEWRLEHRSISLCFVTMLRSRNE

SEQ ID NO: 800348 - protein, 724 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQVRQAVLLSPRWLSHSQVLAPRL

SEQ ID NO: 800349 - protein, 629 aa, Homo sapiens; identical to SEQ ID NO: 800344

SEQ ID NO: 800350 - protein, 433 aa, Homo sapiens [sequence omitted]

SEQ ID NO: 800351 - protein, 292 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVITWCWTRPTCGRVFEWRLEHRSISLCFVTMLRSRNE

SEQ ID NO: 800352 - protein, 394 aa, Homo sapiens
ARRRPGVNRPRRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 800353 - protein, 242 aa, Homo sapiens [sequence omitted]

SEQ ID NO: 800354 - protein, 113 aa, Homo sapiens
MAAPVVAPPGVVVSRANKRSGAGPGGSGGGGARGAEEEPPPPLQAVLVADSFDRRFFPISKDQPRVSAAHASSQRAGRVAGLEQVLISANYNSMPLKDLRLCCYPKTGCRGTV

SEQ ID NO: 800355 - protein, 115 aa, Homo sapiens
SAVCADVIRRWVYPLTPEANFTDSTTQSCTHSRHNIYRGPEVSLGHGSILEENVLLGSGTVIGSNCFITNSVIGPGCHIGEHRWGIKPTILGTGTWGGHVSRNTRDGYTRDSPWE

SEQ ID NO: 800356 - protein, 107 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLL

SEQ ID NO: 800357 - protein, 582 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLK

SEQ ID NO: 800358 - protein, 582 aa, Homo sapiens; identical to SEQ ID NO: 800357

SEQ ID NO: 800359 - protein, 639 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPELHKARSRPFGSVSSH

SEQ ID NO: 800360 - protein, 721 aa, Homo sapiens; identical to SEQ ID NO: 800340

SEQ ID NO: 800361 - protein, 721 aa, Homo sapiens; identical to SEQ ID NO: 800340

SEQ ID NO: 800362 - protein, 808 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEVRKVFQCLFRREEKAMIVSMLVTFDLFCILLRLRREEKQGTGGTVHKEDIFVAVRGRGELKRIRKVVLGGILPVFLAYGDLPFLLIQILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 800363 - protein, 242 aa, Homo sapiens [sequence omitted]

SEQ ID NO: 800364 - protein, 344 aa, Homo sapiens
PTTARYEAGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 800365 - protein, 286 aa, Homo sapiens
YVDTPRVLERGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 800366 - protein, 113 aa, Homo sapiens; identical to SEQ ID NO: 800354

SEQ ID NO: 800367 - protein, 325 aa, Homo sapiens
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVYIYDGELVSKNGFFQGYNRLTWIVVVLQALGGLVIAAVIKYADNILKGFATSLSIILSTLISYFWLQDFVPTSVFFLGAILVITATFLYGYDPKPAGNPTKA

SEQ ID NO: 800368 - protein, 325 aa, Homo sapiens; identical to SEQ ID NO: 800367

SEQ ID NO: 800369 - protein, 307 aa, Homo sapiens
MFANLKYVSLGILVFQTTSLVLTMRYSRTFLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVYIYDGELVSKNGFFQGYNRLTWIVVVLQALGGLVIAAVIKYADNILKGFATSLSIILSTLISYFWLQDFVPTSVFFLGAILVITATFLYGYDPKPAGNPTKA

SEQ ID NO: 800370 - protein, 220 aa, Homo sapiens
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLVSFSLEPSL

SEQ ID NO: 800371 - protein, 325 aa, Homo sapiens; identical to SEQ ID NO: 800367

SEQ ID NO: 800372 - protein, 269 aa, Homo sapiens
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVYIYDGELVSKNGFFQGYNRLTWIVVVLQCLFPWSHPCNNSYFFVWL

SEQ ID NO: 800373 - protein, 137 aa, Homo sapiens
QRSQTRPLRARPSPTRRRAALEPLTVRVLLVVAVVVALHLHVLQKGLDLLLILEVHHAGHGSRRPKDGHARVQWRDFGSPQPPPYGFKQFSCLSLLNSWDYRRPPQCPPNFCIFSRDGVSPYRPGWSRTPDLVIRLN

SEQ ID NO: 800374 - protein, 414 aa, Homo sapiens
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIEKGQILSSAADIAATVQHTMACHLVKRTHRAILFCKQRDLLPQNNAVLVASGGVASNFYIRRALEILTNATQCTLLCPPPRLCTDNGIMIAWNGIERLRAGLGILHDIEGIRYEPKCPLGVDISKEVGEASIKVPQLKMEI

SEQ ID NO: 800375 - protein, 468 aa, Homo sapiens
RSLVTLLGGAARFHPISPMKVSGIIYRVSMLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIFLISKVEQINIPGLCLKIAAHFCRYEKGQILSSAADIAATVQHTMACHLVKRTHRAILFCKQRDLLPQNNAVLVASGGVASNFYIRRALEILTNATQCTLLCPPPRLCTDNGIMIAWNGIERLRAGLGILHDIEGIRYEPKCPLGVDISKEVGEASIKVPQLKMEI

SEQ ID NO: 800376 - protein, 267 aa, Homo sapiens
MEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIEKGQILSSAADIAATVQHTMACHLVKRTHRAILFCKQRDLLPQNNAVLVASGGVASNFYIRRALEILTNATQCTLLCPPPRLCTDNGIMIAWNGIERLRAGLGILHDIEGIRYEPKCPLGVDISKEVGEASIKVPQLKMEI

SEQ ID NO: 800377 - protein, 157 aa, Homo sapiens
LAVISFFFIFTILKLQNAVFLSFRTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVIKN

SEQ ID NO: 800378 - protein, 414 aa, Homo sapiens; identical to SEQ ID NO: 800374

SEQ ID NO: 800379 - protein, 206 aa, Homo sapiens
SLPELEAAEAGAPGSGPVDLFRELLEEGKGVIRGNKEYEEEKRQEKERQEKALGILTYLGQSAAEAQTQPPWYQLPPGRGGPPPGPAPDEKIKSRLDPLREMQKHLGKKRQHGGDEGSRSRKEKEGSEKQRPKEPPSLDQLRAERLRREAAERSRAEALLARVQGRALQEGQPEEDETDDRRRRYNSQFNPQLARRPRQQDPHLTH

SEQ ID NO: 800380 - protein, 106 aa, Homo sapiens
SASFHGQSKPRGQARNQGAGKYPPPTRKPWQAVVADAKTKAKQLSFLPWRRKVVSESQKTLTLHNSCQLLSRAAKLSSSPVSDVKLITDFGCISKGILIKSRCLRD

SEQ ID NO: 800381 - protein, 460 aa, Homo sapiens
MVFSLKVILFLSLLLSPVLKSSLVTLNNNGYDGIVIAINPSVPEDEKLIQNIKEMVTEASTHLFHATKQRAYFRNVSILIPMTYKSKSEYLIPKQETYDQADVIVADLYLKYGDDPYTLQYGQCGDKGQYIHFTPNFLLTNNLATYGPRGKVFVHGWAHLRWGVFDEYNVDQPFYISRRNTTEATRCSTRITVYMVLNECKGASCIARPFRRDSQTGLYEAKCTFIPKRSQTAKESIVFMQNLDSVTEFCTEKTHNKEAPNLKNKMCNHRSTWDVIMSSEDFQHLSPMTEINLPRPTFSLLKSKQRVVCLVLDKSGSMNAEDRLFRMNQAAELYLIQIIEKGSLVGLVTFDSFAKIQSKLIKIIDDNTYQKITANLPQEADGGTSICRGLKAGFQAIPQSNQSTFGSEIILLTDGEDYQISLCFGEVKQSGTVIHTIALGPSADEELETLSNMTGLHKGH

SEQ ID NO: 800382 - protein, 460 aa, Homo sapiens; identical to SEQ ID NO: 800381

SEQ ID NO: 800383 - protein, 443 aa, Homo sapiens
MEEDSLEDSNLPPKVWHSEMTVSVTGEPPSTVEEEGIPKETDIEIIPEIPETLEPLSLPDVLRISAVLEDTTDQLSILNYIMPVQYEGRQSICVKSREMNLEGTNLDKLPMASTITKIPSPLITEEGPNLPEIRHRGRFAVEFNKMQDLVFKKPTRQTIMTTETLKKIQIDRQFFSDVIADTIKELQDSATYNSLLQALSKERENKMHFYDIIAREEKGRKQIISLQKQLINVKKEWQFEVQSQNEYIANLKDQLQEMKAKSNLENRYMKTNTELQIAQTQKKCNRTEELLVEEIEKLRMKTEEEARTHTEIEMFLRKEQQKLEERLEFWMEKYDKDTEMKQNELNALKATKASDLAHLQDLAKMIREYEQVIIEDRIEKERSKKKVKQDLLELKSVIKLQAWWRGTMIRREIGGFKMPKDKVDSKDSKGKGKGKDKRRGKKK

SEQ ID NO: 800384 - protein, 345 aa, Homo sapiens
MNLEGTNLDKLPMASTITKIPSPLITEEGPNLPEIRHRGRFAVEFNKMQDLVFKKPTRQTIMTTETLKKIQIDRQFFSDVIADTIKELQDSATYNSLLQALSKERENKMHFYDIIAREEKGRKQIISLQKQLINVKKEWQFEVQSQNEYIANLKDQLQEMKAKSNLENRYMKTNTELQIAQTQKKCNRTEELLVEEIEKLRMKTEEEARTHTEIEMFLRKEQQKLEERLEFWMEKYDKDTEMKQNELNALKATKASDLAHLQDLAKMIREYEQVIIEDRIEKERSKKKVKQDLLELKSVIKLQAWWRGTMIRREIGGFKMPKDKVDSKDSKGKGKGKDKRRGKKK

SEQ ID NO: 800385 - protein, 144 aa, Homo sapiens [sequence omitted]

SEQ ID NO: 800386 - protein, 135 aa, Homo sapiens
DCWNDSLNHPPLQKLEERLEFWMEKYDKDTEMKQNELNALKATKASDLAHLQDLAKMIREYEQVIIEDRIEKERSKKKVKQDLLELKSVIKLQAWWRGTMIRREIGGFKMPKDKVDSKDSKGKGKGKDKRRGKKK

SEQ ID NO: 800387 - protein, 113 aa, Homo sapiens [sequence omitted]

SEQ ID NO: 800388 - protein, 139 aa, Homo sapiens
LLLSPARLPQPPPASLLKLEERLEFWMEKYDKDTEMKQNELNALKATKASDLAHLQDLAKMIREYEQVIIEDRIEKERSKKKVKQDLLELKSVIKLQAWWRGTMIRREIGGFKMPKDKVDSKDSKGKGKGKDKRRGKKK

SEQ ID NO: 800389 - protein, 436 aa, Homo sapiens
MEEDSLEDSNLPPKVWHSEMTVSVTGEPPSTVEEEGIPKETDIEIIPEIPETLEPLSLPDVLRISAVLEDTTDQLSILNYIMPVQYEGRQSICVKSREMNLEGTNLDKLPMASTITKIPSPLITEEGPNLPEIRHRGRFAVEFNKMQDLVFKKPTRQTIMTTETLKKIQIDRQFFSDVIADTIKELQDSATYNSLLQALSKERENKMHFYDIIAREEKGRKQIISLQKQLINVKKEWQFEVQSQNEYIANLKDQLQEMKAKSNLENRYMKTNTELQIAQTQKKCNRTEELLVEEIEKLRMKTEEEARTHTEIEMFLRKEQQKLEERLEFWMEKYDKDTEMKQNELNALKATKASDLAHLQDLAKMIREYEQVIIEDRIEKERSKKKVKQDLLELKSVIKLQAWWRGTMIRREIGGFKMPKDKVDSKDSKGKGKAAP

SEQ ID NO: 800390 - protein, 443 aa, Homo sapiens; identical to SEQ ID NO: 800383

SEQ ID NO: 800391 - protein, 443 aa, Homo sapiens; identical to SEQ ID NO: 800383

SEQ ID NO: 800392 - protein, 443 aa, Homo sapiens; identical to SEQ ID NO: 800383

SEQ ID NO: 800393 - protein, 138 aa, Homo sapiens
MASRYDGPPTPNPDLQKLEERLEFWMEKYDKDTEMKQNELNALKATKASDLAHLQDLAKMIREYEQVIIEDRIEKERSKKKVKQDLLELKSVIKLQAWWRGTMIRREIGGFKMPKDKVDSKDSKGKGKGKDKRRGKKK

SEQ ID NO: 800394 - protein, 296 aa, Homo sapiens [sequence omitted]

SEQ ID NO: 800395 - protein, 499 aa, Homo sapiens
VVVIIGEFFSASSVTIVDTVTLQYLGKHRDRYGLQRMWGSLGWGLAMLSVGIGIDYTHIEVLIDGKGCKPPEYRNYQIVFIVFGVLMTMALIVATQFRFRYNHFKNDDSKGKEVEIPQVERNNSTESSEETPTTTSHSQAFNFWDLIKLLCSVQYGSVLFVAWFMGFGYGFVFTFLYWHLEDLNGTTTLFGVCSVLSHVSELTAYFFSHKLIELIGHIRVLYIGLACNTARYIYISYLENAWTVLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRASEIQPLQGTNENRENSPAGRAQPVPCETHSDPSRNQPSPDAAASQTQTSPAHPSVDPCTEESEEQQAQLAAGGH

SEQ ID NO: 800396 - protein, 261 aa, Homo sapiens
MLRAGFLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRASEIQPLQGTNENRENSPAGRAQPVPCETHSDPSRNQPSPDAAASQTQTSPAHPSVDPCTEESEEQQAQLAAGGH

SEQ ID NO: 800397 - protein, 595 aa, Homo sapiens
VVVIIGEFFSASSVTIVDTVTLQYLGKHRDRYGLQRMWGSLGWGLAMLSVGIGIDYTHIEVLIDGKGCKPPEYRNYQIVFIVFGVLMTMALIVATQFRFRYNHFKNDDSKGKEVEIPQVERNNSTESSEETPTTTSHSQAFNFWDLIKLLCSVQYGSVLFVAWFMGFGYGFVFTFLYWHLEDLNGTTTLFGVCSVLSHVSELTAYFFSHKLIELIGHIRVLYIGLACNTARYIYISYLENAWTVLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRASEIQPLQLHIGKEDERGPMRIGKILLLVEPSLSHVRLTLTHLETSHPLTQQHLRRRPAPLTPVWTRAQRRVKSSRLSWPREDTEGILLISHPAWNQAPQPGHRVRPPSQDMPPLEEHSTAYASKYLNSLTWKHTHRSYSTYWQEKVNFRNLIGITTGKWSSMRTFSSLLG

SEQ ID NO: 800398 - protein, 166 aa, Homo sapiens
VVVIIGEFFSASSVTIVDTVTLQYLGKHRDRYGLQRMWGSLGWGLAMLSVGIGIDYTHIEVLIDGKGCKPPEYRNYQIVFIVFGVLMTMALIVATQFRFRYNHFKNDDSKGKEVEIPQVERNNSTESSEETPTTTSHSQAFNFWELRASCSSHTLHGIRLLSQDTG

SEQ ID NO: 800399 - protein, 499 aa, Homo sapiens; identical to SEQ ID NO: 800395

SEQ ID NO: 800400 - protein, 499 aa, Homo sapiens; identical to SEQ ID NO: 800395

SEQ ID NO: 800401 - protein, 499 aa, Homo sapiens; identical to SEQ ID NO: 800395

SEQ ID NO: 800402 - protein, 113 aa, Homo sapiens [sequence omitted]

SEQ ID NO: 800403 - protein, 194 aa, Homo sapiens
MLRAGFLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDKGTPGSSRTL

SEQ ID NO: 800404 - protein, 499 aa, Homo sapiens; identical to SEQ ID NO: 800395

SEQ ID NO: 800405 - protein, 404 aa, Homo sapiens
VVVIIGEFFSASSVTIVDTVTLQYLGKHRDRYGLQRMWGSLGWGLAMLSVGIGIDYTHIEVLIDGKGCKPPEYRNYQIVFIVFGVLMTMALIVATQFRFRYNHFKNDDSKGKEVEIPQVERNNSTESSEETPTTTSHSQAFNFWDLIKLLCSVQYGSVLFVAWFMGFGYGFVFTFLYWHLEDLNGTTTLFGVCSVLSHVSELTAYFFSHKLIELIGHIRVLYIGLACNTARYIYISYLENAWTVLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNEEQQAQLAAGGH

SEQ ID NO: 800406 - protein, 158 aa, Homo sapiens [sequence omitted]

SEQ ID NO: 800407 - protein, 499 aa, Homo sapiens; identical to SEQ ID NO: 800395

SEQ ID NO: 800408 - protein, 269 aa, Homo sapiens
VVVIIGEFFSASSVTIVDTVTLQYLGKHRDRYGLQRMWGSLGWGLAMLSVGIGIDYTHIEVLIDGKGCKPPEYRNYQIVFIVFGVLMTMALIVATQFRFRYNHFKNDDSKGKEVEIPQVERNNSTESSEETPTTTSHSQAFNFWDLIKLLCSVQYGSVLFVAWFMGFGYGFVFTFLYWHLEDLNGTTTLFGVCSVLSHVSELTAYFFSHKLIELIGHIRVLYIGLACNTARYIYISYLENAWTVLPMEVLQGKLTAGIEIISLPSLSCG

SEQ ID NO: 800409 - protein, 114 aa, Homo sapiens [sequence omitted]

SEQ ID NO: 800410 - protein, 204 aa, Homo sapiens
MQSYASAMLSVFNSDDYSPAVQENIPALRRSSSFLCTESCNSKYQCETGENSKGNVQDRVKRPMNAFIVWSRDQRRKMALENPRMRNSEISKQLGYQWKMLTEAEKWPFFQEAQKLQAMHREKYPNYKYRPRRKAKMLPKNCSLLPADPASVLCSEVQLDNRLYRDDCTKATHSRMEHQLGHLPPINAASSPQQRDRYSHWTKL

SEQ ID NO: 800411 - protein, 323 aa, Homo sapiens
PRRAAAGPSATLDMALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 800412 - protein, 117 aa, Homo sapiens
MFTTGRSAATTAPCEMARWLDSTSSASRREPRKGFLHSSLTSSAHRHHRSFFLKALLIGVAVSIVEKLFGSAFCKNNQNQEGKLVAGRGILPEEPCLSNRVSGFKENLRLRLSLKWY

SEQ ID NO: 800413 - protein, 127 aa, Homo sapiens [sequence omitted]

SEQ ID NO: 800414 - protein, 323 aa, Homo sapiens; identical to SEQ ID NO: 800411

SEQ ID NO: 800415 - protein, 82 aa, Homo sapiens
TKKRTDEIARWSSQVKGLAGRKVKRLNQKQFSNFDFKFFIRRRHCSHLWGDISNITQKPVFFKSRCSQPHMPCRAGLRTEVL

SEQ ID NO: 800416 - protein, 323 aa, Homo sapiens; identical to SEQ ID NO: 800411

SEQ ID NO: 800417 - protein, 323 aa, Homo sapiens; identical to SEQ ID NO: 800411

SEQ ID NO: 800418 - protein, 323 aa, Homo sapiens; identical to SEQ ID NO: 800411

SEQ ID NO: 800419 - protein, 123 aa, Homo sapiens
MSIALGLSLVLSLALGPCQSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNCQHPMSD

SEQ ID NO: 800420 - protein, 1487 aa, Homo sapiens
MTPLPPDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAINDAACGMEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800421 - protein, 1747 aa, Homo sapiens
TVRHLCLGPSRTSLLLPGPLFTPLASARGLPVSQTRGPLPREGGSKAGSPRVPGWGAVDLPQSCGCGGLRAGPGGTVAWEGALMPGLFQPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800422 - protein, 979 aa, Homo sapiens
LRIQCYYHKQELLQGGEVHRGVLDQLYTSQAEATLPGPTEAPNAPSTVSSGLGAEEPLSSMTDDMGSPLSTGYHTRSGSEEAVTDPGEREAGASLYQGLMRTASELLLDRRLRIPELEEAELFAEGQGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800423 - protein, 1714 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKVPGPRAGAGTRARDMPSP

SEQ ID NO: 800424 - protein, 2562 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKVPGPRAGAGTRARDMPSPKTEALLPREPVVLEALPGLGAHGDMRRAHPLADHEASDLGSCEWVLGAEVGSGVGPVPGRLAAEQGLVQGGPDSHCLLHSCLMAFLRENSCVRPLPHVKSTTQGFLVDSQLSICLLTTSKRNPGPGTAAHPYHPSTVRDPGGRYCSRPGVQDLHGHKRDPASANVKIKQLAGNGSSCLWSQHFGRPKEEDQFEARSFKTSLGNIVSETLSTKNKRELGVMVHTCAPTSRVAGTTGVHHQAWLVFCIFGQVRLKLLTSKCWDDKCEPPHPAVGLFFIRVFSVFLQIHWLEMTELEEFSVILWLLEPYQLKFAENFSNSMDCLLNFLGVFGSTKYLFWKYLVYFVSFAKSRFMKICPFSSKSSIVLALKFRSLIHFEVNFGTWYEAGVAFHSPAWGGACTVLKKVVRSPERSQLPCLRSTTPEHEGSNWTLSSTPLACVCPPLLPPCHTEVRLGLFWAAGSAGECGCVTRRKGRAERMTCVVPPPEKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800425 - protein, 1714 aa, Homo sapiens; identical to SEQ ID NO: 800423

SEQ ID NO: 800426 - protein, 1723 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVNTSVPPTGPKPTL

SEQ ID NO: 800427 - protein, 2038 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWEKEKYRKKKKKKEKKKVSDGKKKGKKVMVKIEKKEISHSIMFEELPCVDRILKLCQDIFLVRETRELELEEELYAKLIFLYRSPETMIKWTREKE

SEQ ID NO: 800428 - protein, 290 aa, Homo sapiens
PCESWCGEAAAVTEGVTCTQLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800429 - protein, 1676 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGSSWCGRLGSWSWRRSCTPSSSSSTAHRRP

SEQ ID NO: 800430 - protein, 1714 aa, Homo sapiens; identical to SEQ ID NO: 800423

SEQ ID NO: 800431 - protein, 171 aa, Homo sapiens
LSYRRPTRSGPKLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYERRP

SEQ ID NO: 800432 - protein, 175 aa, Homo sapiens
MSAQQPSIIPFTAQAYEELSRQFDPQPVSGLPCESWCGEAAAVTEGVTCTQLAMQFISQYSPEDIVTAQIEGSSGALWRISPPSRAQMKRELYNGTADITLRFTWNFQRFVLDLGQCLGGWTHYSGSRCVPTPRDLAKGGTVEYANEKHMLALAPNSTARRQLASLLEGTSDQSV

SEQ ID NO: 800433 - protein, 2035 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSGLGAEEPLSSMTDDMGSPLSTGYHTRSGSEEAVTDPGEREAGASLYQGLMRTASELLLDRRLRIPELEEAELFAEGQGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800434 - protein, 2060 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800435 - protein, 1327 aa, Homo sapiens
HELPPVPSLLPVYSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800436 - protein, 2094 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGVSQARDPNPVYAELSSHPHPLGLAPPDLCSPGHKKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800437 - protein, 1648 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGG

SEQ ID NO: 800438 - protein, 2260 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKIHWLEMTELEEFSVILWLLEPYQLKFAENFSNSMDCLLNFLGVFGSTKYLFWKYLVYFVSFAKSRFMKICPFSSKSSIVLALKFRSLIHFEVNFGTWYEAGVAFHSPAWGGACTVLKKVVLPTERSQLPCLRSTTPEHEGSNWTLSSTPLACVCPPLLPPCHTEVRLGLFWAAGGAGECGCVTRRKGRAERMTCVVPPPEKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800439 - protein, 1714 aa, Homo sapiens; identical to SEQ ID NO: 800423

SEQ ID NO: 800440 - protein, 2070 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKVHKICPFSSKSSIVLALKFRSLIHFEKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKHHGAVRVHRAGHRQVRARILQRDLALHYVRGAAVRGPHPQALPGHLPGAGDSGAGAGGGVVRQAHLPLPLTGDHDQVDS

SEQ ID NO: 800441 - protein, 381 aa, Homo sapiens
QAGFEVRGSAKERKRDNKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 800442 - protein, 1892 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRRWMQSGALDAVRGVGWR

SEQ ID NO: 800443 - protein, 1762 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSVGLWLLELKPLKQHDMTDHWCMPPWVTCAIKTLHVACEEGMSPDPLGELLSARVASSCTHGDSIAGLCHADACVLVTWRLAAIPTKLGLDVRRSLFVPDGRRGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYERRP

SEQ ID NO: 800444 - protein, 1714 aa, Homo sapiens; identical to SEQ ID NO: 800423

SEQ ID NO: 800445 - protein, 168 aa, Homo sapiens
ADYLGVRIQLRREQGAGATGFLEWWVIELQECRTDCNLLPMVIFSDKVSPPSLGFLAGYGLSEWLGGTPQLGGLRAAPGLTSFPRSIMGLYVSIVLVIGKFVRGFFSEISHSIMFEELPCVDRILKLCQDIFLVRETRELELEEELYAKLIFLYRSPETMIKWTREKE

SEQ ID NO: 800446 - protein, 188 aa, Homo sapiens
YVCLSDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 800447 - protein, 247 aa, Homo sapiens
MAAAIASGLIRQKRQAREQHWDRPSASRRRSSPSKNRGLCNGNLVDIFSKVRIFGLKKRRLRRQDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 800448 - protein, 152 aa, Homo sapiens
MAAAIASGLIRQKRQAREQHWDRPSASRRRSSPSKNRGLCNGNLVDIFSKVRIFGLKKRRLRRQDPQLKGIVTRLYCRQGYYLQMHPDGALDGTKDDSTNSTLFNLIPVGLRVVAIQGVKTGLYIAMNGEGYLYPSVSKTPKISAIRSMHVK

SEQ ID NO: 800449 - protein, 98 aa, Homo sapiens
QRLMKQRSRHSIHLNLPNATAVKRSHRRSPWRQSPSDPGDPLLSGTVQPTPGDRGARQPLADPLETEGHTAAIFVDASSGQSGSAQAESQIIFRNTTG

SEQ ID NO: 800450 - protein, 109 aa, Homo sapiens [sequence omitted]

SEQ ID NO: 800451 - protein, 461 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGVFYLSFHPF

SEQ ID NO: 800452 - protein, 417 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAPRKRQGGPLE

SEQ ID NO: 800453 - protein, 436 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGESTHLELRPAGFKSWLHHGVTM

SEQ ID NO: 800454 - protein, 438 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGFEQLTACDWLKLGCNDWLRLGYLL

SEQ ID NO: 800455 - protein, 417 aa, Homo sapiens; identical to SEQ ID NO: 800452

SEQ ID NO: 800456 - protein, 233 aa, Homo sapiens
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKGLKCSSCEPFPDGATNNLSRSNSDESNFSEKLRASTVMYHPEGESSTTPFFSTNSSLNLPVLEVGRTENTIFSSTTLPRPGDPGAPPLPPDLQLEEEGTCANSSEMFLPLRSRTVSRQ

SEQ ID NO: 800457 - protein, 233 aa, Homo sapiens; identical to SEQ ID NO: 800456

SEQ ID NO: 800458 - protein, 233 aa, Homo sapiens; identical to SEQ ID NO: 800456

SEQ ID NO: 800459 - protein, 233 aa, Homo sapiens; identical to SEQ ID NO: 800456

SEQ ID NO: 800460 - protein, 104 aa, Homo sapiens
APSQGGAAQPELPDPEEAPSPASTMEPTAPSLTEEDLTEVKKDVSNAAVPRAGGGGLQPSGRRKRKPGVRGQGGSSRSEERKVLAQEDCGEPCIRGTLVAVILQ

SEQ ID NO: 800461 - protein, 662 aa, Homo sapiens
PFPPRPAWRSGLSSRRTLRMAPKSGQEVEETEEEALLSPTEQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQQPRPWPQLDTGSPESSGKHSERHHKTVEWGSLPCLNTSSSGGADSDSSSCRPGLPSFVQVIGHPPRDHRASSEQALVQAGSYSRDSEDLQKTHSPRHGEPVLSPQPCTDPDHWSPELLQSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 800462 - protein, 662 aa, Homo sapiens; identical to SEQ ID NO: 800461

SEQ ID NO: 800463 - protein, 294 aa, Homo sapiens
SCAGGPAASPHSVSSLPSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 800464 - protein, 244 aa, Homo sapiens
MRWLRPAGRRREQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKRVPEERGP

SEQ ID NO: 800465 - protein, 633 aa, Homo sapiens
MRWLRPAGRRREQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQQPRPWPQLDTGSPESSGKHSERHHKTVEWGSLPCLNTSSSGGADSDSSSCRPGLPSFVQVIGHPPRDHRASSEQALVQAGSYSRDSEDLQKTHSPRHGEPVLSPQPCTDPDHWSPELLQSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 800466 - protein, 662 aa, Homo sapiens; identical to SEQ ID NO: 800461

SEQ ID NO: 800467 - protein, 62 aa, Homo sapiens
MCLLLPGQGFRLEDVDWNSVARRYPNLFTNMEPSSKQKVTAQSRDSPGARREGSPWQVKTQD

SEQ ID NO: 800468 - protein, 247 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 800469 - protein, 134 aa, Homo sapiens
MGLRLRPASQALTHSCQAGRLSSSWGVCTQSLCSVGWSRTPAPRAGRRWPGCLFPVRSGKVRRPSSWPCAEAGTCSRGSRAGVGRGAAWPPPRRAASRPRPAASTARPGAWRSRSCASWGSAAPSGGAERSSTP

SEQ ID NO: 800470 - protein, 247 aa, Homo sapiens; identical to SEQ ID NO: 800468

SEQ ID NO: 800471 - protein, 168 aa, Homo sapiens
MLELVALTGTMVYSITNNFPFSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 800472 - protein, 160 aa, Homo sapiens
MLRPTFRSVGLASRSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 800473 - protein, 182 aa, Homo sapiens
MLRPTFRSVGLASRPLPQDSPQQRPGAGHCGWLTSSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 800474 - protein, 109 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFRPAFLPPNS

SEQ ID NO: 800475 - protein, 260 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKASPGSHQLPQRAHRPALSHHSLPAVWGLPGPNLHFHSGNRRSPDGWDLCGLLSLQRPHRRPAALLLECKASPQAEKGAVEPATGVIPFPLIHPTSGFSPSEPACWCDLLILHSSALADFLSQGFLLVETNG

SEQ ID NO: 800476 - protein, 120 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLV

SEQ ID NO: 800477 - protein, 260 aa, Homo sapiens
PPSEPPRAPLELAYGGGADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 800478 - protein, 138 aa, Homo sapiens
MLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 800479 - protein, 294 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRVGTRSKGQDVVGAGSGGRVEDQSVGVLYLGEHGKSSGDRAKGLNSSPLLQAATNYHNGHTGQLSAITVFLLFGGSLARIFTSIQETGDPLMAGTFVVSSLCNGLIAAQLLFYWNAKPPHKQKKAQ

SEQ ID NO: 800480 - protein, 192 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGAGDLPKSRLCGSWEPCWELSFSRQPPTTTTGTQASSQPSQSSCCLGAPWPESSLPFRKPEIP

SEQ ID NO: 800481 - protein, 119 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFRLRGPPFHPKGNTHNSNGD

SEQ ID NO: 800482 - protein, 188 aa, Homo sapiens
ASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 800483 - protein, 128 aa, Homo sapiens
ESWFQTSEGHGQQTVVSPFLALLTLEPTFRHLLRIMQVSTAALAVLLCTMALCNQVLSASLAADTPTACCFSYTSRQIPQNFIADYFETSSQCSKPGVIFLTKRSRQVCADPSEEWVQKYVSDLELSA

SEQ ID NO: 800484 - protein, 125 aa, Homo sapiens
GELVSDFRRTRAADSGQSFLGSADTRAHIPSPAQNHAGLHCCPCCPPLHHGSLQPGPLCITSLSFVVGITTLWPWLDHINLFLWPKSPQEKRELLKGLPNILVFLFKTFIFISRRGLSPLVSSCC

SEQ ID NO: 800485 - protein, 171 aa, Homo sapiens
GELVSDFRRTRAADSGQSFLGSADTRAHIPSPAQNHAGLHCCPCCPPLHHGSLQPGPLCITSLSFVVGITTLWPWLDHINLFLWPKSPQEKRELLKGLPNILVFLFKTFIFISRRGLSPLVSRYENLGRGRGVTVPFTDRKTGFETNQLARGRIQGCLLPSGVCCSLSSSL

SEQ ID NO: 800486 - protein, 123 aa, Homo sapiens
MEVGRVRVGAETGQKAILERPSLQEPIGDTGRRAPRCDLTWSWSEACVTESGRAAPAQRKGTGRRRQRDTLRAPLPGVTERSSLDGDRQGAPERGASPELPRTESRMVGPWWAQDSPAGFPSA

SEQ ID NO: 800487 - protein, 171 aa, Homo sapiens; identical to SEQ ID NO: 800485

SEQ ID NO: 800488 - protein, 117 aa, Homo sapiens
GELVSDFRRTRAADSGQSFLGSADTRAHIPSPAQNHAGLHCCPCCPPLHLAADTPTACCFSYTSRQIPQNFIADYFETSSQCSKPGVIFLTKRSRQVCADPSEEWVQKYVSDLELSA

SEQ ID NO: 800489 - protein, 171 aa, Homo sapiens; identical to SEQ ID NO: 800485

SEQ ID NO: 800490 - protein, 111 aa, Homo sapiens
PFPFPIREDHCWGSQKTERVASDRAPRVCELAHLLQQERWNLSSEEYACSGNQPAILPDGIKKLKFTRSPHLESEKPDPSPIMIPQVTTCCLLANSFPCPFCVYEAPVSAS

SEQ ID NO: 800491 - protein, 90 aa, Homo sapiens
RGVRRGDGRWAAAELRVPPRPQRPGRPLWAACGGGAVAKLSACVDHPRIPVWCCPSSRLPHSHWLGDSCLLRRVVEAQKMMRLLNCGGID

SEQ ID NO: 800492 - protein, 419 aa, Homo sapiens
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVRLEQKIKRNDVEIEEEEFWENELQIEQENEKQLKDQLQEIRQKITECENKLKDYLAQIRTMESGLEAEKLQREVQEAQVNEEEVKGKIGKVKGEIDIQGQQSLRLENGIKAVERSLGQATKRLQDKEQELEQLTKELRQVNLQQFIQQTGTKVTVLPAEPIEIEASHADIEREAPFQSGSLKRPGSSRQLPSNLRILQNPISSGFNPEGIYV

SEQ ID NO: 800493 - protein, 419 aa, Homo sapiens; identical to SEQ ID NO: 800492

SEQ ID NO: 800494 - protein, 419 aa, Homo sapiens; identical to SEQ ID NO: 800492

SEQ ID NO: 800495 - protein, 419 aa, Homo sapiens; identical to SEQ ID NO: 800492

SEQ ID NO: 800496 - protein, 419 aa, Homo sapiens; identical to SEQ ID NO: 800492

SEQ ID NO: 800497 - protein, 419 aa, Homo sapiens; identical to SEQ ID NO: 800492

SEQ ID NO: 800498 - protein, 419 aa, Homo sapiens; identical to SEQ ID NO: 800492

SEQ ID NO: 800499 - protein, 419 aa, Homo sapiens; identical to SEQ ID NO: 800492

SEQ ID NO: 800500 - protein, 419 aa, Homo sapiens; identical to SEQ ID NO: 800492

SEQ ID NO: 800501 - protein, 210 aa, Homo sapiens [sequence omitted]

SEQ ID NO: 800502 - protein, 244 aa, Homo sapiens
LVHPLGDLVHVARRVEALLAGPALLQLGAVSVAFAEEVLVAQWGPVHRVLVVQALLSAGHHLVNAGLDLGALVLAEEAHLADAALHLARLLLLLQLLLLIVAALGVRVLLILALGPGHRVRFGGSGGCGCGGYGGCGSGGGLPAARLIVVPGRHGLELLTQVLSAEPPCVSGGPGGGRRGSGRGVGPQERRVMQRWRQRGFFLLHLLHVPRGRGAGSASCRGGLLRRRGPTPDQTLGRPARPAL

SEQ ID NO: 800503 - protein, 159 aa, Homo sapiens
MPRRAAAETRPDSRPDPRTPGPARTLKLSARRHGQPARRPPAPLLSGLLTAHAQCCRPPRLRALRACACVQAGSAEAPAQAQTGTACRPPPLPHSLRGFKGTLSNSNLSSRRAASRTEGLPLQGCAHIANSVAVPRHGIVRTPADASTPGRIHQGTATT

SEQ ID NO: 800504 - protein, 439 aa, Homo sapiens
MREWGTRRGASRVRAWGRASGAAGHATVATTGLLPPPPSPRPAGQGRRQRLMPRRAAAETRPDSRPDPRTPGPARTLKLSARRHGQPARRPPAPLLSGLLFDSQPHLLLASPAEPHRSDTMEKVKVESTDLVVLALVTRADFELGKVDIVAINDTFIDLVSSIDHIDIMHCNAETEACINEYHHISRQILKSSGDRGLVRRESTASFTTMEKAGLICRGSQKVIISAPSAVAPKFVMGVNHEKYDNSLKIISNASCTTNCFSTLAKVIHDNFGIVKELMTTVHAITATQKTVDGPPGNCGVMARGSPELHPCLYLVAAKAVGKVIPELNGKLTGMAFRVPTANVSVVDLTCRLEKPAKYDDIKKVVKQASEGPLKGILGYTEHQVVSSDFNSYTHSSTFDAGAGIALNDHFVKLISWYDNEFGYSNRVVDLMAHMASKE

SEQ ID NO: 800505 - protein, 181 aa, Homo sapiens
LVHPLGDLVHVARRVEALLAGPALLQLGAVSVAFAEEVLVAQWGPVHRVLVVQALLSAGHHLVNAGLDLGALVLAEEAHLADAALHLARLLLLLQLLLLIVAALGVRVLLILALGPGHRMEFRSVARLECNGAISAHCNLRLPGLSDSPASASRVAETTGMHHHAQLIFVFLVETGFHHVG

SEQ ID NO: 800506 - protein, 227 aa, Homo sapiens
QAPEPLSSLKSMAERAAISSGIEDPVPTLHLTERDIILSSTSAPPASAQPPLQLSEVNIPLSLGVCPLGPVALTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQVRAPPSLPAARVGVESPGSRQPLLASAPLPPPFSWRSPSA

SEQ ID NO: 800507 - protein, 219 aa, Homo sapiens
QAPEPLSSLKSMAERAAISSGIEDPVPTLHLTERDIILSSTSAPPASAQPPLQLSEVNIPLSLGVCPLGPVALTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQGTYIYFDYEKWGQRKKEGFTFEYRYLEDRDLQ

SEQ ID NO: 800508 - protein, 102 aa, Homo sapiens
VDCGEWVVGPPRPPNRAGESIWGLCQAALAPAAQVLRPGLLFPPQAPEPLSSLKSMAERAAISSGIEDPVPTLHLTERGEGPRMVGKQRAKEEGLPLTHPHH

SEQ ID NO: 800509 - protein, 89 aa, Homo sapiens
GRNGDPAGGDGGGTRGDGYWASHESLRPLEAGSLAANSSEEAALLPGARWFAEACYEELVQVKRLLSGNRLRVAAAGMEPTRIFCKHLY

SEQ ID NO: 800510 - protein, 146 aa, Homo sapiens
MPRPATTTAAAAAAATAGPQSAAAATARLPAQQSVPLPADAQPGLHQLHLAQIQGIIVRLVVVFVLLLLGAAVLLTALLVLVELVVVALVRVHGATRGGPADAGRGGERAGTPRPRLSLRLRLMSGRRPGSGPASRGSSPGAAVGV

SEQ ID NO: 800511 - protein, 660 aa, Homo sapiens
TPGPEAPPPAAMSSFGAGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800512 - protein, 864 aa, Homo sapiens
GAANPGPRIVLGGLAGGVPTPLSGHPGDDPSAGPGAGRLMPGELSWGCWNEGRCYGNGRQGLVGGTGPGLDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800513 - protein, 851 aa, Homo sapiens
GAANPGPRIVLGGLAGGVPTPLSGHPGDDPSAGPGAGRLMPGELSWGCWNEGRCYGNGRQGLVGGTGPGLDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800514 - protein, 807 aa, Homo sapiens
MGVIPEGPLWVSGSDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800515 - protein, 627 aa, Homo sapiens
MFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800516 - protein, 766 aa, Homo sapiens
GAANPGPRIVLGGLAGGVPTPLSGHPGDDPSAGPGAGRLMPGELSWGCWNEGRCYGNGRQGLVGGTGPGLDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800517 - protein, 556 aa, Homo sapiens
GASLLLVATSHTIFKCGLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800518 - protein, 753 aa, Homo sapiens
MATGGRAWLGGPGPGWDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800519 - protein, 967 aa, Homo sapiens
GAANPGPRIVLGGLAGGVPTPLSGHPGDDPSAGPGAGRLMPGELSWGCWNEGRCYGNGRQGLVGGTGPGLDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYLEMGFHHLGQAGLELLTSGDSSQMLWLMLPPGITDVSHHARPDAGLKVDAPAYAAGCEDPKHVMPSQPVLTGDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800520 - protein, 465 aa, Homo sapiens
RLGSGLGVNGRGRPGQVAGTTKEGKPLPPHVRIWDSVSLSTLHVLGLGVFDRAVCCVGFSKSCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800521 - protein, 263 aa, Homo sapiens
LEGNGTISAHCNLRLPGSSDSSASASRELGLQDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800522 - protein, 152 aa, Homo sapiens
GRLLLLNSRPRRPHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800523 - protein, 433 aa, Homo sapiens
MATGGRAWLGGPGPGWDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLISRRGREFIEVGDPGISDR

SEQ ID NO: 800524 - protein, 533 aa, Homo sapiens
MVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800525 - protein, 896 aa, Homo sapiens
GAANPGPRIVLGGLAGGVPTPLSGHPGDDPSAGPGAGRLMPGELSWGCWNEGRCYGNGRQGLVGGTGPGLDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800526 - protein, 929 aa, Homo sapiens
GAANPGPRIVLGGLAGGVPTPLSGHPGDDPSAGPGAGRLMPGELSWGCWNEGRCYGNGRQGLVGGTGPGLDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKAGVQWHNLGSLQPPPPRFQQILLTQPPEELRLQCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800527 - protein, 803 aa, Homo sapiens
KLVLVWSFRDHDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800528 - protein, 896 aa, Homo sapiens; identical to SEQ ID NO: 800525

SEQ ID NO: 800529 - protein, 627 aa, Homo sapiens; identical to SEQ ID NO: 800515

SEQ ID NO: 800530 - protein, 509 aa, Homo sapiens
RLGSGLGVNGRGRPGQVAGTTKEGKPLPPHVRIWDSVSLSTLHVLGLGVFDRAVCCVGFSKSCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800531 - protein, 742 aa, Homo sapiens
GAANPGPRIVLGGLAGGVPTPLSGHPGDDPSAGPGAGRLMPGELSWGCWNEGRCYGNGRQGLVGGTGPGLDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPGPFQFYHPPGLGPGQQLLCHQLRGL

SEQ ID NO: 800532 - protein, 333 aa, Homo sapiens
MGSDAQLRPPSDILGKVFPGSRWGRVSCWGSSSICLALVLSGKRPGLLSPPAVLPFHQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800533 - protein, 226 aa, Homo sapiens
MIWLERTSITHSTTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800534 - protein, 158 aa, Homo sapiens
ARRNVKPLREGFGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 800535 - protein, 586 aa, Homo sapiens
MATGGRAWLGGPGPGWDRGGRRWLWWGDGGARPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQACLRCSLPPCLPPSLVLRSSYWRKSQQALCFLFPTAWAGSCPHICSGTSCRTAPSPSAVYTFTL

SEQ ID NO: 800536 - protein, 116 aa, Homo sapiens
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDEEKNFDQTRFLEDSLLNW

SEQ ID NO: 800537 - protein, 116 aa, Homo sapiens; identical to SEQ ID NO: 800536

SEQ ID NO: 800538 - protein, 104 aa, Homo sapiens
CAGSAGNSAAPRDPILEQPAPSPRPGTALCREELRFKRGLSRARLSLSPRSRFCRGSPLHLRPEPEKGPLRPATAGKTKPKSPTTNYSGGSNHLTGVPSEITRR

SEQ ID NO: 800539 - protein, 104 aa, Homo sapiens; identical to SEQ ID NO: 800538

SEQ ID NO: 800540 - protein, 116 aa, Homo sapiens; identical to SEQ ID NO: 800536

SEQ ID NO: 800541 - protein, 76 aa, Homo sapiens
WQQQQLDAERRSWELARPAPRQWWQGRPRLALRLPKPYWLAAVQPALWLPGCAEVPRELGPEVQLRGKDEAQIPNY

SEQ ID NO: 800542 - protein, 114 aa, Homo sapiens
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDDENNHHQPSLLEGRMR

SEQ ID NO: 800543 - protein, 641 aa, Homo sapiens
MAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLISNAQDLAQEVQTVLKPVHHKEGQELTALLNTPHIQALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 800544 - protein, 675 aa, Homo sapiens
MTTSHMNGHVTEESDSEVKNVDLASPEEHQKHREMAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLISNAQDLAQEVQTVLKPVHHKEGQELTALLNTPHIQALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 800545 - protein, 641 aa, Homo sapiens; identical to SEQ ID NO: 800543

SEQ ID NO: 800546 - protein, 641 aa, Homo sapiens; identical to SEQ ID NO: 800543

SEQ ID NO: 800547 - protein, 124 aa, Homo sapiens
MTTSHMNGHVTEESDSEVKNVDLASPEEHQKHREMAVDCPGDLGTRMMPIRRSAQLERIRQQQEDMRRRREEEGKKQELDLNSSMRLKKLAQIPPKTGIDNPMFDTEEGIVLESPHYAVKILGK

SEQ ID NO: 800548 - protein, 641 aa, Homo sapiens; identical to SEQ ID NO: 800543

SEQ ID NO: 800549 - protein, 675 aa, Homo sapiens; identical to SEQ ID NO: 800544

SEQ ID NO: 800550 - protein, 503 aa, Homo sapiens
MNKASPPFPLISNAQDLAQEVQTVLKPVHHKEGQELTALLNTPHIQALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 800551 - protein, 470 aa, Homo sapiens
DQRIPVRRRLSYAALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 800552 - protein, 110 aa, Homo sapiens
GGRREAAIFRRRWPRRFRAARLEPEAGPPSGTRNHSLPAFRSCIPEARLKLAGTLPACPVPTGTPVADTGCGESECWRAAVPAAAPADSFPPPPAFPCPADVMRSVEPQG

SEQ ID NO: 800553 - protein, 103 aa, Homo sapiens [sequence omitted]

SEQ ID NO: 800554 - protein, 130 aa, Homo sapiens
GEAMPRPASARARCAHTLACAHCLALPSEMNPAPQMEMQKSPVFCDAHAGSCRPELFLFGHLGSSSYDPLLKSGIRPQEMTGKKMPVINIEDLTEKDKLKMEVDQLKKEVTLERMLIPARHLQNQSLMDY

SEQ ID NO: 800555 - protein, 321 aa, Homo sapiens
MAADVTGKSDPFCVVELNNDRLLTHTVYKNLNPEWNKVFTFNIKDIHSVLEVTVYDEDRDRSADFLGKVAIPLLSIQNGEQKAYVLKNRQLTGPTKGVIYLEIDVIFNAVKASLRTLIPKEQKYIEEENRLSKQLLLRNFIRMKRCVMVLVNAAYYVNSCFDWDSPPRSLAAFVVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 800556 - protein, 321 aa, Homo sapiens; identical to SEQ ID NO: 800555

SEQ ID NO: 800557 - protein, 333 aa, Homo sapiens
TRWLLRREVTERGAGIGPCWGRCVVIGRRPGGARVRHGCASGSSGWRPVLWAGAFTMASAELDYTIEIPDQPCWSQKNSPSPGGKEAETRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 800558 - protein, 153 aa, Homo sapiens
TRWLLRREVTERGAGIGPCWGRCVVIGRRPGGARVRHGCASGSSGWRPVLWAGAFTMASAELDYTIEIPDQPCWSQKNSPSPGGKEAETRQPVVILLGWGGCKDKNLAKYSAIYHKRKLLELLFDYEIEKEAGSCWAQAIPTCSPQSATKAQL

SEQ ID NO: 800559 - protein, 160 aa, Homo sapiens
MLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 800560 - protein, 194 aa, Homo sapiens
TRWLLRREVTERGAGIGPCWGRCVVIGRRPGGARVRHGCASGSSGWRPVLWAGAFTMASAELDYTIEIPDQPCWSQKNSPSPGGKEAETRQPVVILLGWGGCKDKNLAKYSAIYHKRKLLELLFDYEIEKEPLLFHVFSNGGVMLYRYVLELLQTRRFCRLRVVGTIFDSAPGDSNLATGRGLSLARALPLLEG

SEQ ID NO: 800561 - protein, 257 aa, Homo sapiens
TRWLLRREVTERGAGIGPCWGRCVVIGRRPGGARVRHGCASGSSGWRPVLWAGAFTMASAELDYTIEIPDQPCWSQKNSPSPGGKEAETRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVFCMASCLLLSPLLVDGISAGTEGQLTLRPDWAAQVLTRLGCHLQCITRS

SEQ ID NO: 800562 - protein, 142 aa, Homo sapiens
MHITGRQHGHKGAPPAAVPTWWNGWMTSHQPRPLGFQQMDTQQRPGTRVPMSTCQLLVPRKPPSRRVVARIRFCPHHSYSSKRLLFSCSMSTASSSAMQEPSLCEEQSRIMLGPGHPHLLPTVCNEGTALAPAVVCQVGPQL

SEQ ID NO: 800563 - protein, 142 aa, Homo sapiens; identical to SEQ ID NO: 800562

SEQ ID NO: 800564 - protein, 303 aa, Homo sapiens
TRWLLRREVTERGAGIGPCWGRCVVIGRRPGGARVRHGCASGSSGWRPVLWAGAFTMASAELDYTIEIPDQPCWSQKNSPSPGGKEAETRQPVVILLGWGGCKDKNLAKYSAIYHKRKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 800565 - protein, 333 aa, Homo sapiens; identical to SEQ ID NO: 800557

SEQ ID NO: 800566 - protein, 167 aa, Homo sapiens
TRWLLRREVTERGAGIGPCWGRCVVIGRRPGGARVRHGCASGSSGWRPVLWAGAFTMASAELDYTIEIPDQPCWSQKNSPSPGGKEAETRQPVVILLGWGGCKDKNLAKYSAIYHKRVFCMASCLLLSPLLVDGISAGTEGQLTLRPDWAAQVLTRLGCHLQCITRS

SEQ ID NO: 800567 - protein, 151 aa, Homo sapiens
MVDLKVAAYLDPQIRALWETKGPARESSGQSKKSPQMDCLDPKSSCWHFRNFTYDEAGGPREAVSKLQELCHLWLKPEIHSKEQILELLVLEQFLTILPRETQTQMQKHHPQSIEEAVALVEHLQRESGQTWNGVRRKIPDMYSEIGCRWI

SEQ ID NO: 800568 - protein, 145 aa, Homo sapiens
VPLGAGIRPGGARRPRSQKPQPGPAVPQRRAPPAPDRAATRLSHPALHVKSPLRAWHAGKAVSGDPVRGRTVNGCRLSSSPLCTQPQRAHFSELRIPSQLLKVADGKVSSFRNCRIRSCSARTANAYPKMWNPDLPMRGARLEVA

SEQ ID NO: 800569 - protein, 206 aa, Homo sapiens
RLGFESAADCSRKCRSLSQGMELSCPGSRCPVQEQRARWERKRACTARELLETERRYQEQLGLVATYFLGILKAKGTLRPPERQALFGSWELIYGASQELLPYLEGGCWGQGLEGFCRHLELYNQFAANSERSQTTLQEQLKKNKGFRRFVRLQEGRPEFGGLQLQDLLPLPLQRLQQYENLVVALAENTGPNSPDHQQLTPVLPS

SEQ ID NO: 800570 - protein, 352 aa, Homo sapiens
RLGFESAADCSRKCRSLSQGMELSCPGSRCPVQEQRARWERKRACTARELLETERRYQEQLGLVATYFLGILKAKGTLRPPERQALFGSWELIYGASQELLPYLEGGCWGQGLEGFCRHLELYNQFAANSERSQTTLQEQLKKNKGFRRFVRLQEGRPEFGGLQLQDLLPLPLQRLQQYENLVVALAENTGPNSPDHQQLTRAARLISETAQRVHTIGQKQKNDQHLRRVQALLSGRQAKGLTSGRWFLRQGWLLVVPPHGEPRPRMFFLFTDVLLMAKPRPPLHLLRSGTFACKALYPMAQCHLSRVFGHSGGPVVGLSFPHEKLLLMSTDQEELSRWYHSLTWAISSQKN

SEQ ID NO: 800571 - protein, 114 aa, Homo sapiens
MVHSFMFRSSCWAPARVVTLKKCPLSGSQPMSPFLPPATNSPKIHRIIALLTAQKGGPAGPSGCSGAALSGPAVVSTGPAVALGIREKRGQKWLCIFCCPLNSPDPAQTSAKPT

SEQ ID NO: 800572 - protein, 90 aa, Homo sapiens
MTLSSTDMYTVSLLLCLFFKKSDPDPGPFQNNLFHNHGTQSQSCMGSKVGDVIPGAARLISETAQRVHTIGQKQKNDQHLRRVQALLSGR

SEQ ID NO: 800573 - protein, 352 aa, Homo sapiens; identical to SEQ ID NO: 800570

SEQ ID NO: 800574 - protein, 352 aa, Homo sapiens; identical to SEQ ID NO: 800570

SEQ ID NO: 800575 - protein, 352 aa, Homo sapiens; identical to SEQ ID NO: 800570

SEQ ID NO: 800576 - protein, 255 aa, Homo sapiens
MAGQPPPAEDARVRRVTAQPPVGAHSCPLLLRVPELIRLPGAPGGTGDHFVSPLLHREADHPALQPLRTAGDHRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGIVSWGEGCGRPNRPGVYTRVPAYVNWIRRHITASGGSESGYPRLPLLAGFFLPGLFLLLVSCVLLAKCLLHPSADGTPFPAPD

SEQ ID NO: 800577 - protein, 226 aa, Homo sapiens
MAGQPPPAEDARVRRVTAQPPVGAHSCPLLLRVPELIRLPGAPGGTGDHFVSPLLHREADHPALQPLRTAGDHRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGIVSWGEGCGRPNRPGVYTRVPAYVNWIRFQRPLRQPLQAGALCPLPGGPAMNYM

SEQ ID NO: 800578 - protein, 321 aa, Homo sapiens
MALGACGLLLLLAVPGVSLRTLQPGCGRPQVSDAGGRIVGGHAAPAGAWPWQASLRLRRMHVCGGSLLSPQWVLTAAHCFSGSLNSSDYQVHLGELEITLSPHFSTVRQIILHSSPSGQPGTSGDIALVELSVPVTLSSRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGIVSWGEGCGRPNRPGVYTRVPAYVNWIRRHITASGGSESGYPRLPLLAGFFLPGLFLLLVSCVLLAKCLLHPSADGTPFPAPD

SEQ ID NO: 800579 - protein, 1807 aa, Homo sapiens
GSPQRLCDLAGPSSTESESRKRSISKRKSHLDLLKLIMDGMTEACIKGGIEACYAAVSCVCTLLGALDELSQGKGLSEGQVQLLLLRLEELKDGAEWSRDSMEINEADFRWQRRVLSSEHTPWESGNERSLDISISVTTDTGQTTLEGELGQTTPEDHSGNHKNSLKSPAIPEGKETLSKVLETEAVDQPDVVQRSHTVPYPDITNFLSVDCRTRSYGSRYSESNFSVDDQDLSRTEFDSCDQYSMAAEKDSGRSDVSDIGSDNCSLADEEQTPRDCLGHRSLRTAALSLKLLKNQEADQHSARLFIQSLEGLLPRLLSLSNVEEVDTALQNFASTFCSGMMHSPGFDGNSSLSFQMLMNADSLYTAAHCALLLNLKLSHGDYYRKRPTLAPGVMKDFMKQVQTSGVLMVFSQAWIEELYHQVLDRNMLGEAGYWGSPEDNSLPLITMLTDIDGLESSAIGGQLMASAATESPFAQSRRIDDSTVAGVAFARYILVGCWKNLIDTLSTPLTGRMAGSSKGLAFILGAEGIKEQNQKERDAICMSLDGLRKAARLSCALGVAANCASALAQMAAASCVQEEKEEREAQEPSDAITQVKLKVEQKLEQIGKVQGVWLHTAHVLCMEAILSVGLEMGSHNPDCWPHVFRVCEYVGTLEHNHFSDGASQPPLTISQPQKATGSAGLLGDPECEGSPPEHSPEQGRSLSTAPVVQPLSIQDLVREGSRGRASDFRGGSLMSGSSAAKVVLTLSTQADRLFEDATDKLNLMALGGFLYQLKKASQSQLFHSVTDTVDYSLAMPGEVKSTQDRKSALHLFRLGNAMLRIVRSKARPLLHVMRCWSLVAPHLVEAACHKERHVSQKAVSFIHDILTEVLTDWNEPPHFHFNEALFRPFERIMQLELCDEDVQDQVVTSIGELVEVCSTQIQSGWRPLFSALETVHGGNKSEMKEYLVGDYSMGKGQAPVFDVFEAFLNTDNIQVFANAATSYIMCLMKFVKGLGEVDCKEIGDCAPAPGAPSTDLCLPALDYLRRCSQLLAKIYKMPLKPIFLSGRLAGLPRRLQEQSASSEDGIESVLSDFDDDTGLIEVWIILLEQLTAAVSNCPRQHQPPTLDLLFELLRDVTKTPGPGFGIYAVVHLLLPVMSVWLRRSHKDHSYWDMASANFKHAIGLSCELVVEHIQSFLHSDIRYESMINTMLKDLFELLVACVAKPTETISRVGCSCIRYVLVTAGPVFTEEMWRLACCALQDAFSATLKPVKDLLGCFHSGTESFSGEGCQVRVAAPSSSPSAEAEYWRIRAMAQQVFMLDTQCSPKTPNNFDHAQSCQLIIELPPDEKPNGHTKKSVSFREIVVSLLSHQVLLQNLYDILLEEFVKGPSPGEEKTIQVPEAKLAGFLRYISMQNLAVIFDLLLDSYRTAREFDTSPGLKCLLKKVSGIGGAANLYRQSAMSFNIYFHALVCAVLTNQETITAEQVKKVLFEDDERSTDSSQQCSSEDEDIFEETAQVSPPRGKEKRQWRARMPLLSVQPVSNADWVWLVKRLHKLCMELCNNYIQMHLDLENCMEEPPIFKGDPFFILPSFQSESSTPSTGGFSGKETPSEDDRSQSREHMGESLSLKAGGGDLLLPPSPKVEKKDPSRKKEWWENAGNKIYTMAADKTISKLMTEYKKRKQQHNLSAFPKEVKVEKKGEPLGPRGQDSPLLQRPQHLMDQGQMRHSFSAGPELLRQDKRPRSGSTGSSLSVSVRDAEAQIQAWTNMVLTVLNQIQILPDQTFTALQPAVFPCISQLTCHVTDIRVRQAVREWLGRVGRVYDIIV

SEQ ID NO: 800580 - protein, 1807 aa, Homo sapiens; identical to SEQ ID NO: 800579

SEQ ID NO: 800581 - protein, 1807 aa, Homo sapiens; identical to SEQ ID NO: 800579

SEQ ID NO: 800582 - protein, 1174 aa, Homo sapiens
GSPQRLCDLAGPSSTESESRKRSISKRKSHLDLLKLIMDGMTEACIKGGIEACYAAVSCVCTLLGALDELSQGKGLSEGQVQLLLLRLEELKDGAEWSRDSMEINEADFRWQRRVLSSEHTPWESGNERSLDISISVTTDTGQTTLEGELGQTTPEDHSGNHKNSLKSPAIPEGKETLSKVLETEAVDQPDVVQRSHTVPYPDITNFLSVDCRTRSYGSRYSESNFSVDDQDLSRTEFDSCDQYSMAAEKDSGRSDVSDIGSDNCSLADEEQTPRDCLGHRSLRTAALSLKLLKNQEADQHSARLFIQSLEGLLPRLLSLSNVEEVDTALQNFASTFCSGMMHSPGFDGNSSLSFQMLMNADSLYTAAHCALLLNLKLSHGDYYRKRPTLAPGVMKDFMKQVQTSGVLMVFSQAWIEELYHQVLDRNMLGEAGYWGSPEDNSLPLITMLTDIDGLESSAIGGQLMASAATESPFAQSRRIDDSTVAGVAFARYILVGCWKNLIDTLSTPLTGRMAGSSKGLAFILGAEGIKEQNQKERDAICMSLDGLRKAARLSCALGVAANCASALAQMAAASCVQEEKEEREAQEPSDAITQVKLKVEQKLEQIGKVQGVWLHTAHVLCMEAILSVGLEMGSHNPDCWPHVFRVCEYVGTLEHNHFSDGASQPPLTISQPQKATGSAGLLGDPECEGSPPEHSPEQGRSLSTAPVVQPLSIQDLVREGSRGRASDFRGGSLMSGSSAAKVVLTLSTQADRLFEDATDKLNLMALGGFLYQLKKASQSQLFHSVTDTVDYSLAMPGEVKSTQDRKSALHLFRLGNAMLRIVRSKARPLLHVMRCWSLVAPHLVEAACHKERHVSQKAVSFIHDILTEVLTDWNEPPHFHFNEALFRPFERIMQLELCDEDVQDQVVTSIGELVEVCSTQIQSGWRPLFSALETVHGGNKSEMKEYLVGDYSMGKGQAPVFDVFEAFLNTDNIQVFANAATSYIMCLMKFVKGLGEVDCKEIGDCAPAPGAPSTDLCLPALDYLRRCSQLLAKIYKMPLKPIFLSGRLAGLPRRLQEQSASSEDGIESVLSDFDDDTGLIEVWIILLEQLTAAVSNCPRQHQPPTLDLLFELLRDVTKTPGPGVVFYAGVPELRIPLIHWSLGLFPCVEQPPPPPPPPPPPPSPPPPPPPPPP

SEQ ID NO: 800583 - protein, 282 aa, Homo sapiens [sequence omitted]

SEQ ID NO: 800584 - protein, 276 aa, Homo sapiens
MRGMKLLGALLALAALLQGAVSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLVCVLPCTAT

SEQ ID NO: 800585 - protein, 222 aa, Homo sapiens
MRGMKLLGALLALAALLQGAVSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEEMGLGGRHVDGRLQCGLQLCETLPVVIHPPVDKPHLPVADPRQR

SEQ ID NO: 800586 - protein, 134 aa, Homo sapiens
MNQEGRRVLGHRAVMAVSHQGAPFATLDVALASLSKVTLGPPDKRQGDWSPAPPSRTYLAHPCPILEDGGHHTCKGHGIGTFGLVIRHFKTKCKRDYQVQFLQQQETCAYRKKHVLATHLCGKPHRAIVFCTLR

SEQ ID NO: 800587 - protein, 213 aa, Homo sapiens
MPPSSATLCRDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 800588 - protein, 222 aa, Homo sapiens; identical to SEQ ID NO: 800585

SEQ ID NO: 800589 - protein, 90 aa, Homo sapiens
VREFAIVPLHAAPGDAVAEIDALYDVYLDVQEEMGLGGEALPGAVGTSGLRMSQGHRQRFLVGRHVDGRLQCGLQLCETLPVVIHPPVDK

SEQ ID NO: 800590 - protein, 122 aa, Homo sapiens
MKITRGVHRQVPSCQQLLQKPMFFFSPILRHSQNWSERGVKWDTSFKVGKPKKGASTSSLSSFSPAFFGRIRGTGAALGKVCPTRVSQLVARRGGGEGGSSSEPVTARMIEPASRLPRSPRT

SEQ ID NO: 800591 - protein, 146 aa, Homo sapiens [sequence omitted]

SEQ ID NO: 800592 - protein, 122 aa, Homo sapiens; identical to SEQ ID NO: 800590

SEQ ID NO: 800593 - protein, 146 aa, Homo sapiens [sequence omitted]

SEQ ID NO: 800594 - protein, 336 aa, Homo sapiens
GRRQLVRLDNHGGGSGRPPRLSAPPAAPLTQVPCAPRLLREGRSHRPTWCAPWPLTPPPFPCPTLAPGPAHGGPRGTKRAAPGSPPTDAVTFQNVLKATHSDSRPREAGRPRGAGPRGDSLLLAARRAGTVTLGGDWSGSAMANPPLSKDPLFSLADLLNDRAVCHLRCSRDPQRPPHPAGPFPPNGCGWIIEGVEGRLGHGHERRGRDVANGDQESEWTRQTLPRARTGSLPASSTHGSSPPGWCPHFTVEEAETKVTQRARGRAGSDSIHSQDALTRIFHLAGAWRGRNGEVRECCRGDIGTRSCSELKCSRQRAPVGLSWPGRRGPLGSTRGL

SEQ ID NO: 800595 - protein, 282 aa, Homo sapiens
GRRQLVRLDNHGGGSGRPPRLSAPPAAPLTQVPCAPRLLREGRSHRPTWCAPWPLTPPPFPCPTLAPGPAHGGPRGTKRAAPGSPPTDAVTFQNVLKATHSDSRPREAGRPRGAGPRGDSLLLAARRAGTVTLGGDWSGSAMANPPLSKDPLFSLADLLNDRAVCHLRCSRDPQRPPHPAGPFPPNGCGWIIEGVEGRLGHGHERRGRDVANGDQESEWTRQTLPRARTGSLPASSTHGSSPPGWCPHFTVEEAETKGLGGDGTVRSENAAEGTLGPGLAVS

SEQ ID NO: 800596 - protein, 98 aa, Homo sapiens
RMPVNPRAPSPARWFSSPPSLGGVGLGVFCFHYCTPSPKDNGTALLHSALPQTGDRSCSSPGWTPNLHIRTAMDHGAMKVKTGALITHGSHFVAQAGV

SEQ ID NO: 800597 - protein, 110 aa, Homo sapiens
GFSQNTQDSGQGLEGAPGSMLGNTHGLIGAGWACQPSRGPRVPTKGLLLQRPLCWQGLHYHHLPGLHPSIRVAAVAPEETRLCLKVLPSAPAGALPAGVARIHTESTDLP

SEQ ID NO: 800598 - protein, 284 aa, Homo sapiens
KHLGVSTVERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 800599 - protein, 284 aa, Homo sapiens; identical to SEQ ID NO: 800598

SEQ ID NO: 800600 - protein, 767 aa, Homo sapiens
RRRALCWAPAAPATACGARGTMISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATLSAFAAVYVSVSPAPHCPSQALLLTRGEPSLTPTPMPQMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYRSPSDRDSASIVTIDAHAPHHPVVHLSAGGAPWEWKAAGGGAKAEADGGYELGDLARGFRGGAKPPGVSPGSSVSDVDQEEPRFGAVATVNLATGEGLPPLGAADGALGPGSRESTLRRHAGGLGLAEREAEAEAEGYFRKMQARRFPD

SEQ ID NO: 800601 - protein, 696 aa, Homo sapiens
RRRALCWAPAAPATACGARGTMISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATLSAFAAVYVSMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYRSPSDRDSASIVTIDAHAPHHPVVHLSAGGAPWEWKAAGGGAKAEADGGYELGDLARGFRGGAKPPGVSPGSSVSDVDQEEPRFGAVATVNLATGEGLPPLGAADGALGPGSRESTLRRHAGGLGLAEREAEAEAEGYFRKMQARRFPD

SEQ ID NO: 800602 - protein, 696 aa, Homo sapiens; identical to SEQ ID NO: 800601

SEQ ID NO: 800603 - protein, 310 aa, Homo sapiens
DPRVGLVLDREQTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYARRRIAACDMSAARHAGTVAGPGMEGGGGSGGEERGRRSGAPGSFGEERGANAEARWRKPPRAGETTAAAGL

SEQ ID NO: 800604 - protein, 617 aa, Homo sapiens
RRRALCWAPAAPATACGARGTMISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATLSAFAAVYVSMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAIPRCGATRAAWGWRSARRRRRPRATSARCRRAASPTSAAGPGAGGGRAEGAGGRA

SEQ ID NO: 800605 - protein, 259 aa, Homo sapiens
RRRALCWAPAAPATACGARGTMISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATAGGLGLAEREAEAEAEGYFRKMQARRFPD

SEQ ID NO: 800606 - protein, 1135 aa, Homo sapiens
MGDFAAPAAAANGSSICINSSLNSSLGGAGIGVNNTPNSTPAAPSSNHPAAGGCGGSGGPGGGSAAVPKHSTVVERLRQRIEGCRRHHVNCENRYQQAQVEQLELERRDTVSLYQRTLEQRAKKSGAGTGKQQHPSKPQQDAEAASAEQRNHTLIMLQETVKRKLEGARSPLNGDQQNGACDGNFSPTSKRIRKDISAGMEAINNLPSNMPLPSASPLHQLDLKPSLPLQNSGTHTPGLLEDLSKNGRLPEIKLPVNGCSDLEDSFTILQSKDLKQEPLDDPTCIDTSETSLSNQNKLFSDINLNDQEWQELIDELANTVPEDDIQDLFNEDFEEKKEPEFSQPATETPLSQESASVKSDPSHSPFAHVSMGSPQARPSSSGPPFSTVSTATSLPSVASTPAAPNPASSPANCAVQSPQTPNQAHTPGQAPPRPGNGYLLNPAAVTVAGSASGPVAVPSSDMSPAEQLKQMAAQQQQRAKLMQQKEQQQQQQQQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQEQHPVGLPRTTGPMQSSVPPGSGGMVSGASPAGPGFLGSQPQAAIMKQMLIDQRAQLIEQQKQQFLREQRRSSSSSSSRFWRNSSCSNHIYPGSTSSHSWNPYPVQQVNQFQGSPQDIAAVRSQAALQSMRTSRLMAQNAGMMGIGPSQNPGTMATAAAQSEMGLAPYSTTPTSQPGMYNMSTGMTQMLQHPNQSGMSITHNQAQGPRQPASGQGVGMVSGFGQSMLVNSAITQQHPQMKGPVGQALPRPQAPPRLQSLMGTVQQGAQSWQQRSLQGMPGRTSGELGPFNNGASYPLQAGQPRLTKQHFPQGLSQSVVDANTGTVRTLNPAAMGRQMMPSLPGQQGTSQARPMVMSGLSQGVPGMPAFSQPPAQQQIPSGSFAPSSQSQAYERNAPQDVSYNYSGDGAGGSFPGLPDGADLVDSIIKGGPGDEWMQELDELFGNP

SEQ ID NO: 800607 - protein, 1135 aa, Homo sapiens; identical to SEQ ID NO: 800606

SEQ ID NO: 800608 - protein, 739 aa, Homo sapiens
MGDFAAPAAAANGSSICINSSLNSSLGGAGIGVNNTPNSTPAAPSSNHPAAGGCGGSGGPGGGSAAVPKHSTVVERLRQRIEGCRRHHVNCENRYQQAQVEQLELERRDTVSLYQRTLEQRAKKSGAGTGKQQHPSKPQQDAEAASAEQRNHTLIMLQETVKRKLEGARSPLNGDQQNGACDGNFSPTSKRIRKDISAGMEAINNLPSNMPLPSASPLHQLDLKPSLPLQNSGTHTPGLLEDLSKNGRLPEIKLPVNGCSDLEDSFTILQSKDLKQEPLDDPTCIDTSETSLSNQNKLFSDINLNDQEWQELIDELANTVPEDDIQDLFNEDFEEKKEPEFSQPATETPLSQESASVKSDPSHSPFAHVSMGSPQARPSSSGPPFSTVSTATSLPSVASTPAAPNPASSPANCAVQSPQTPNQAHTPGQAPPRPGNGYLLNPAAVTVAGSASGPVAVPSSDMSPAEQLKQMAAQQQQRAKLMQQKQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQVSVKVTHSSSSSCGAFQDCRCVMFYKASTVVGSNCLQKTSLQHPQVVARFGVFFFHFS

SEQ ID NO: 800609 - protein, 724 aa, Homo sapiens
KLTARYEAGFESAEAPGQAPPRPGNGYLLNPAAVTVAGSASGPVAVPSSDMSPAEQLKQMAAQQQQRAKLMQQKAQQQQQQQQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQEQHPVGLPRTTGPMQSSVPPGSGGMVSGASPAGPGFLGSQPQAAIMKQMLIDQRAQLIEQQKQQFLREQRRSSSSSSSRFWRNSSCSNHIYPGSTSSHSGIQYPVQQVNQFQGSPQDIAAVRSQAALQSMRTSRLMAQNAGMMGIGPSQNPGTMATAAAQSEMGLAPYSTTPTSQPGMYNMSTGMTQMLQHPNQSGMSITHNQAQGPRQPASGQGVGMVSGFGQSMLVNSAITQQHPQMKGPVGQALPRPQAPPRLQSLMGTVQQGAQSWQQRSLQGMPGRTSGELGPFNNGASYPLQAGQPRLTKQHFPQGLSQSVVDANTGTVRTLNPAAMGRQMMPSLPGQQGTSQARPMVMSGLSQGVPGMPAFSQPPAQQQIPSGSFAPSSQSQAYERNAPQDVSYNYSGDGAGGSFPGLPDGADLVDSIIKGGPGDEWMQELDELFGNP

SEQ ID NO: 800610 - protein, 774 aa, Homo sapiens
MGDFAAPAAAANGSSICINSSLNSSLGGAGIGVNNTPNSTPAAPSSNHPAAGGCGGSGGPGGGSAAVPKHSTVVERLRQRIEGCRRHHVNCENRYQQAQVEQLELERRDTVSLYQRTLEQRAKKSGAGTGKQQHPSKPQQDAEAASAEQRNHTLIMLQETVKRKLEGARSPLNGDQQNGACDGNFSPTSKRIRKDISAGMEAINNLPSNMPLPSASPLHQLDLKPSLPLQNSGTHTPGLLEDLSKNGRLPEIKLPVNGCSDLEDSFTILQSKDLKQEPLDDPTCIDTSETSLSNQNKLFSDINLNDQEWQELIDELANTVPEDDIQDLFNEDFEEKKEPEFSQPATETPLSQESASVKSDPSHSPFAHVSMGSPQARPSSSGPPFSTVSTATSLPSVASTPAAPNPASSPANCAVQSPQTPNQAHTPGQAPPRPGNGYLLNPAAVTVAGSASGPVAVPSSDMSPAEQLKQMAAQQQQRAKLMQQKEQQQQQQQQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQEQHPVGLPRTTGPMQSSVPPGSGGMVSGASPAGPGFLGSQPQAAIMKQMLIDQRAQLIEQQKQQFLREQRRSSSSSSSRFWRNR

SEQ ID NO: 800611 - protein, 525 aa, Homo sapiens
MEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 800612 - protein, 412 aa, Homo sapiens
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 800613 - protein, 586 aa, Homo sapiens
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 800614 - protein, 495 aa, Homo sapiens
MEFCVEDSTDVHVLIEDHRIVFSCKNADGVELYNEIEFYAKVNSKDSQDKRSSRSITCFVRKWKEKVAWPRLTKEDIKLLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 800615 - protein, 323 aa, Homo sapiens
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRRPSCS

SEQ ID NO: 800616 - protein, 323 aa, Homo sapiens; identical to SEQ ID NO: 800615

SEQ ID NO: 800617 - protein, 267 aa, Homo sapiens [sequence omitted]

SEQ ID NO: 800618 - protein, 303 aa, Homo sapiens
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTS

SEQ ID NO: 800619 - protein, 246 aa, Homo sapiens
LEREQMIEPGGSEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 800620 - protein, 303 aa, Homo sapiens; identical to SEQ ID NO: 800618

SEQ ID NO: 800621 - protein, 278 aa, Homo sapiens
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKSMPVSVPSITSHF

SEQ ID NO: 800622 - protein, 119 aa, Homo sapiens
GCAGPSLVRRQRTGLGEGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 800623 - protein, 199 aa, Homo sapiens
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDDDSDSADDATSN

SEQ ID NO: 800624 - protein, 313 aa, Homo sapiens
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWVKQLLNLRA

SEQ ID NO: 800625 - protein, 89 aa, Homo sapiens
FTYFHQPDDRGTINDISVLRVTRRGEQADHFTQTPLDPGSQVLVRVDWERRFDHMQQHSGQHLITAVADHLFKLKTTSCADHARSCSSR

SEQ ID NO: 800626 - protein, 412 aa, Homo sapiens; identical to SEQ ID NO: 800612

SEQ ID NO: 800627 - protein, 412 aa, Homo sapiens
QASLRVRLLTRLQFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 800628 - protein, 277 aa, Homo sapiens
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLNCLRDLLRISPGP

SEQ ID NO: 800629 - protein, 362 aa, Homo sapiens
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRVAEVLEGKGAGKKGRFQGKATKMSRRMEAQALLQDYISTQSAKE

SEQ ID NO: 800630 - protein, 318 aa, Homo sapiens
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHR

SEQ ID NO: 800631 - protein, 267 aa, Homo sapiens [sequence omitted]

SEQ ID NO: 800632 - protein, 334 aa, Homo sapiens
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLNVGDEKGGGLFLLAGPPASVETLGPRVAEVLEGKGAGKKGRFQGKATKMSRRMEAQALLQDYISTQSAKE

SEQ ID NO: 800633 - protein, 367 aa, Homo sapiens
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVVGAEGSCGKP

SEQ ID NO: 800634 - protein, 199 aa, Homo sapiens; identical to SEQ ID NO: 800623

SEQ ID NO: 800635 - protein, 308 aa, Homo sapiens
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGKGWDGGHNTGAVAMYGDAVMTET

SEQ ID NO: 800636 - protein, 126 aa, Homo sapiens
MWPQVPSSKNIVATCRSCARVYETIPHSHSHRPQSIGPEGAPTIGGELSFRIHPKVPLVPIPTTPPGLARATSPHMTPQERQPCILTQPAACPALPYKTVEERTSEPPLKPFVLFFLGTGTNLFAQ

SEQ ID NO: 800637 - protein, 919 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNALDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 800638 - protein, 919 aa, Homo sapiens; identical to SEQ ID NO: 800637

SEQ ID NO: 800639 - protein, 919 aa, Homo sapiens; identical to SEQ ID NO: 800637

SEQ ID NO: 800640 - protein, 945 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNEGQSVLHSCPGGRDQVPQRRLCEATAVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNALDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 800641 - protein, 873 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNALDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 800642 - protein, 563 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNEGQSVLHSCPGGRDQVPQRRLCEATAVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNALDVGASGLNTSHSPSASSRSSHKSSHTAMSEPTSVAEPAHPAHDARVL

SEQ ID NO: 800643 - protein, 294 aa, Homo sapiens
MTPTSQAFLFCSQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 800644 - protein, 716 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNALDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQVNVLLASFTPCL

SEQ ID NO: 800645 - protein, 390 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYSGRYRARS

SEQ ID NO: 800646 - protein, 51 aa, Homo sapiens
MFFGSTLKFSAQFSMFQTIKDQLEQRTRILQANIRWQQEELHKIQEQLCLV

SEQ ID NO: 800647 - protein, 179 aa, Homo sapiens
CLMCVFQDKGSSLEPRQHFNALDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQAHLLTASTY

SEQ ID NO: 800648 - protein, 919 aa, Homo sapiens; identical to SEQ ID NO: 800637

SEQ ID NO: 800649 - protein, 865 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNALDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVLGHTL

SEQ ID NO: 800650 - protein, 816 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVMQFGKGKSCCYRFLTKGQQWIWLQTHYYITYHQWNSKPEFIVCTHSVVSYADVRVERRQELALEDPPSEALHSSALKDKGSSLEPRQHFNALDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 800651 - protein, 963 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNEGQSVLHSCPGGRDQVPQRRLCEATAVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNALDVGASGLNTSHSPSASSRSSHKSSHTAMSEPTCPNFGFSKGKKNPPKPPKPTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 800652 - protein, 238 aa, Homo sapiens
EVSWRDGPGLSPSLTFLIEMMLQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 800653 - protein, 207 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLESHFRDCEESRCHVLVARMFPF

SEQ ID NO: 800654 - protein, 385 aa, Homo sapiens
FAARAAGLSQEPRDPRGCGPGAAAAEPGDPQPRRRRRRRQQLEQRLPPPPGRSSPRPLAASSPSGGGRRVSPAQSAPGPAGPLRPAPRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVMQFGKGKSCCYRFLTKGQQWIWLQTHYYITYHQWNSKPEFIVCTHSVVSYADVRVERRQELALEDPPSEALHSSALKDKPKPGTAQRELV

SEQ ID NO: 800655 - protein, 122 aa, Homo sapiens
MVPGPPESVVRFFLWFCFLLPPTRKASCDPRDLKSCNRPCVWSRLLKPNSSLSNLETAYFPQNLRFLRPWYFSRSHLNYHQKAPARWEWLYSIYRKGTKAQRRNVLRSPCAPPQPSWPCSVI

SEQ ID NO: 800656 - protein, 109 aa, Homo sapiens [sequence omitted]

SEQ ID NO: 800657 - protein, 122 aa, Homo sapiens; identical to SEQ ID NO: 800655

SEQ ID NO: 800658 - protein, 273 aa, Homo sapiens
CQSLDSYDAMNILPKKSWHVRNKDNVARVRRDEAQAREEEKERERRVLLAQQEARTEFLRKKARHQNSLPELEAAEAGAPGSGPVDLFRELLEEGKGVIRGNKEYEEEKRQEKERQEKALGILTYLGQSAAEAQTQPPWYQLPPGRGGPPPGPAPDEKIKSRLDPLREMQKHLGKKRQHGGDEGSRSRKEKEGSEKQRPKEPPSLDQLRAERLRREAAERSRAEALLARVQGRALQEGQPEEDETDDRRRRYNSQFNPQLARRPRQQDPHLTH

SEQ ID NO: 800659 - protein, 703 aa, Homo sapiens
MLRGRSLSVTSLGGLPQWEVEELPVEELLLFEVAWEVTNKVGGIYTVIQTKAKTTADEWGENYFLIGPYFEHNMKTQVEQCEPVNDAVRRAVDAMNKHGCQVHFGRWLIEGSPYVVLFDIGYSAWNLDRWKGDLWEACSVGIPYHDREANDMLIFGSLTAWFLKEVTDHADGKYVVAQFHEWQAGIGLILSRARKLPIATIFTTHATLLGRYLCAANIDFYNHLDKFNIDKEAGERQIYHRYCMERASVHCAHVFTTVSEITAIEAEHMLKRKPDVVTPNGLNVKKFSAVHEFQNLHAMYKARIQDFVRGHFYGHLDFDLEKTLFLFIAGRYEFSNKGADIFLESLSRLNFLLRMHKSDITVMVFFIMPAKTNNFNVETLKGQAVRKQLWDVAHSVKEKFGKKLYDALLRGEIPDLNDILDRDDLTIMKRAIFSTQRQSLPPVTTHNMIDDSTDPILSTIRRIGLFNNRTDRVKVILHPEFLSSTSPLLPMDYEEFVRGCHLGVFPSYYEPWGYTPAECTVMGIPSVTTNLSGFGCFMQEHVADPTAYGIYIVDRRFRSPDDSCNQLTKFLYGFCKQSRRQRIIQRNRTERLSDLLDWRYLGRYYQHARHLTLSRAFPDKFHVELTSPPTTEGFKYPRPSSVPPSPSGSQASSPQSSDVEDEVEDERYDEEEEAERDRLNIKSPFSLSHVPHGKKKLHGEYKN

SEQ ID NO: 800660 - protein, 690 aa, Homo sapiens
MLRGRSLSVTSLGGLPQWEVEELPVEELLLFEVAWEVTNKVGGIYTVIQTKAKTTADEWGENYFLIGPYFEHNMKTQVEQCEPVNDAVRRAVDAMNKHGCQVHFGRWLIEGSPYVVLFDIGYSAWNLDRWKGDLWEACSVGIPYHDREANDMLIFGSLTAWFLKEVTDHADGKYVVAQFHEWQAGIGLILSRARKLPIATIFTTHATLLGRYLCAANIDFYNHLDKFNIDKEAGERQIYHRYCMERASVHCAHVFTTVSEITAIEAEHMLKRKPSAVHEFQNLHAMYKARIQDFVRGHFYGHLDFDLEKTLFLFIAGRYEFSNKGADIFLESLSRLNFLLRMHKSDITVMVFFIMPAKTNNFNVETLKGQAVRKQLWDVAHSVKEKFGKKLYDALLRGEIPDLNDILDRDDLTIMKRAIFSTQRQSLPPVTTHNMIDDSTDPILSTIRRIGLFNNRTDRVKVILHPEFLSSTSPLLPMDYEEFVRGCHLGVFPSYYEPWGYTPAECTVMGIPSVTTNLSGFGCFMQEHVADPTAYGIYIVDRRFRSPDDSCNQLTKFLYGFCKQSRRQRIIQRNRTERLSDLLDWRYLGRYYQHARHLTLSRAFPDKFHVELTSPPTTEGFKYPRPSSVPPSPSGSQASSPQSSDVEDEVEDERYDEEEEAERDRLNIKSPFSLSHVPHGKKKLHGEYKN

SEQ ID NO: 800661 - protein, 358 aa, Homo sapiens
MLRGRSLSVTSLGGLPQWEVEELPVEELLLFEVAWEVTNKVGGIYTVIQTKAKTTADEWGENYFLIGPYFEHNMKTQVEQCEPVNDAVRRAVDAMNKHGCQVHFGRWLIEGSPYVVLFDIGYSAWNLDRWKGDLWEACSVGIPYHDREANDMLIFGSLTAWFLKEVTDHADGKYVVAQFHEWQAGIGLILSRARKLPIATIFTTHATLLGRYLCAANIDFYNHLDKFNIDKEAGERQIYHRYCMERASVHCAHVFTTVSEITAIEAEHMLKRKPDVVTPNGLNVKKFSAVHEFQNLHAMYKARIQDFVRGHFYGHLDFDLEKTLFLFIAGRYEFSNKGADIFLESLSRLNFLLRVRKL

SEQ ID NO: 800662 - protein, 703 aa, Homo sapiens; identical to SEQ ID NO: 800659

SEQ ID NO: 800663 - protein, 366 aa, Homo sapiens
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 800664 - protein, 281 aa, Homo sapiens
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 800665 - protein, 281 aa, Homo sapiens; identical to SEQ ID NO: 800664

SEQ ID NO: 800666 - protein, 324 aa, Homo sapiens
AKRGRESKLRNTQQVLPRLGLAGGYWRHPGGPVSQVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 800667 - protein, 281 aa, Homo sapiens
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTGEGHPGLGLWWTHLIDLGILSEPHPEHSQPLQGEGEGQTQSRQAWTLQGQEGCPHSWVGNEQTEMDSFLSHRC

SEQ ID NO: 800668 - protein, 281 aa, Homo sapiens; identical to SEQ ID NO: 800664

SEQ ID NO: 800669 - protein, 204 aa, Homo sapiens
MHSVPATGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 800670 - protein, 281 aa, Homo sapiens; identical to SEQ ID NO: 800664

SEQ ID NO: 800671 - protein, 288 aa, Homo sapiens
EGSQKDCYRDTMLDSYENTVPQGSFLQLSMMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNEL

SEQ ID NO: 800672 - protein, 258 aa, Homo sapiens
MPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNEL

SEQ ID NO: 800673 - protein, 258 aa, Homo sapiens; identical to SEQ ID NO: 800672

SEQ ID NO: 800674 - protein, 678 aa, Homo sapiens
GQILGRMEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 800675 - protein, 548 aa, Homo sapiens
MPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 800676 - protein, 282 aa, Homo sapiens
MPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVWMSMVKSVLLLLKMEASEDMSAASMTASMSPRRPLGMSFTTSRGMAMLEQVV

SEQ ID NO: 800677 - protein, 155 aa, Homo sapiens
MPQYLRKRFGGRRIRLYLSVLSLFLYIFTKISVDMFSGAVFIQQALGWNIYASVIALLGITMIYTVTGGLAALMYTDTVQTFVILGGACILMGYAFHEEKYKYAFEMTSFKEKSPELPTPVVGYYSKTTQEPKLSYCLIKCNHSSFLKTHSCYSH

SEQ ID NO: 800678 - protein, 667 aa, Homo sapiens
MRPGGLVGSVPLSPCAEPTEALWAATSWQDAAWCGGRETGWAGNGRGLEKQPCSLPPLATQVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 800679 - protein, 629 aa, Homo sapiens
MCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 800680 - protein, 199 aa, Homo sapiens
MFLMVMPGMISRILYPGNIPAPPLSCASNRAPVAQFRHPPKTRQFGPGVPPPSGGRTPPLLGFPVPTSWDSQTRPRPNGAVASLWQDEVACVVPEVCRRVCGTEVGCSNIAYPRLVVKLMPNGKGSPGPQAQARCGARCWEGSSLAQLQPPWTPSGPSLTAAVRPAGLRGLMLAVMLAALMSSLASIFNSSSTLFTMDI

SEQ ID NO: 800681 - protein, 780 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSRHKQHSMILVPMNTPGVKIIRPLSVFGYTDNFHGGHFEIHFNQVRVPATNLILGEGRGFEISQGRLGPGRIHHCMRTVGLAERALQIMCERATQRIAFKKKLYAHEVVAHWIAESRIAIEKIRLLTLKAAHSMDTLGSAGAKKEIAMIKVAAPRAVSKIVDWAIQVCGGAGVSQDYPLANMYAITRVLRLADGPDEVHLSAIATMELRDQAKRLTAKI

SEQ ID NO: 800682 - protein, 660 aa, Homo sapiens
MEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSRHKQHSMILVPMNTPGVKIIRPLSVFGYTDNFHGGHFEIHFNQVRVPATNLILGEGRGFEISQGRLGPGRIHHCMRTVGLAERALQIMCERATQRIAFKKKLYAHEVVAHWIAESRIAIEKIRLLTLKAAHSMDTLGSAGAKKEIAMIKVAAPRAVSKIVDWAIQVCGGAGVSQDYPLANMYAITRVLRLADGPDEVHLSAIATMELRDQAKRLTAKI

SEQ ID NO: 800683 - protein, 563 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSR

SEQ ID NO: 800684 - protein, 563 aa, Homo sapiens; identical to SEQ ID NO: 800683

SEQ ID NO: 800685 - protein, 563 aa, Homo sapiens; identical to SEQ ID NO: 800683

SEQ ID NO: 800686 - protein, 546 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSAKKRRL

SEQ ID NO: 800687 - protein, 283 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECSSYKQLLDGEPATMVLLGDLSISVLLGPGRPWYTRFLGNRGPPGATRP

SEQ ID NO: 800688 - protein, 762 aa, Homo sapiens
MKPGATGESDLAEVLPQHKFDSKSLEAYLNQHLSGFGAEREATLTIAQYRAGKSNPTFYLQKGFQTYVLRKIQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSRHKQHSMILVPMNTPGVKIIRPLSVFGYTDNFHGGHFEIHFNQVRVPATNLILGEGRGFEISQGRLGPGRIHHCMRTVGLAERALQIMCERATQRIAFKKKLYAHEVVAHWIAESRIAIEKIRLLTLKAAHSMDTLGSAGAKKEIAMIKVAAPRAVSKIVDWAIQVCGGAGVSQDYPLANMYAITRVLRLADGPDEVHLSAIATMELRDQAKRLTAKI

SEQ ID NO: 800689 - protein, 411 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKQLSADSATWTMP

SEQ ID NO: 800690 - protein, 563 aa, Homo sapiens; identical to SEQ ID NO: 800683

SEQ ID NO: 800691 - protein, 476 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPGYYIN

SEQ ID NO: 800692 - protein, 176 aa, Homo sapiens
MGPAEAGRRGAASPVPPPLVRVAPSLFLGSARAAGAEEQLARAGVTLCVNVSRQQPGPRAPGVAELRVPVFDDPAEDLLAHLEPTCAAMEAAVRAGGACLVYCKNGRSRSAAVCTAYLMRHRGLSLAKAFQMVKSARPVAEPNPGFWSQLQKYEEALQAQSCLQGEPPALGLGPEA

SEQ ID NO: 800693 - protein, 260 aa, Homo sapiens [sequence omitted]

SEQ ID NO: 800694 - protein, 176 aa, Homo sapiens; identical to SEQ ID NO: 800692

SEQ ID NO: 800695 - protein, 245 aa, Homo sapiens
MGPAEAGRRGAASPVPPPLVRVAPSLFLGSARAAGAEEQLARAGVTLCVNVSRQQPGPRAPGVAELRVPVFDDPAEDLLAHLEPTCAAMEAAVRAGGACLVYCKNGRSRSAAVCTVIPVNVGQPAGAQSLDDGSFQTGVKRASLSAGMHETLIPRRLRGLSSISMRSPSCLRSVPAWEESPQSFGFGAPLEVAVAQAFAYGHDLHFVMDREVGPLCRSRNTMIGLVYSLVKKTLTRVLHLSLYPD

SEQ ID NO: 800696 - protein, 252 aa, Homo sapiens [sequence omitted]

SEQ ID NO: 800697 - protein, 260 aa, Homo sapiens [sequence omitted]

SEQ ID NO: 800698 - protein, 124 aa, Homo sapiens
WVDRGCGLTVASNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIREALGLI

SEQ ID NO: 800699 - protein, 763 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEVQQGPRGSLGPPGFAATAAVPPRAGGGEGTKAQYLAAKALKKQSWRFHTKYMMWFQRHEEPKTITDEFEQVRAPPPLFPLLGLG

SEQ ID NO: 800700 - protein, 724 aa, Homo sapiens
PTRPGKMADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEVQQGPRGSLGPPGFAATAAVPPRAGGVRALRHSIWQPRP

SEQ ID NO: 800701 - protein, 609 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLPR

SEQ ID NO: 800702 - protein, 247 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSRQ

SEQ ID NO: 800703 - protein, 753 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQGTYIYFDYEKWGQRKKEGFTFEYRYLEDRDLQ

SEQ ID NO: 800704 - protein, 763 aa, Homo sapiens; identical to SEQ ID NO: 800699

SEQ ID NO: 800705 - protein, 771 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDEGPSRCSAAPEPGPGLRQQKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEPRDVRTAWVDSEAGPLRHTSAPLPVAHWLTRGPSPALLQQPQSRPTPLCSSAHSQASLETTGELSSPLPTPLL

SEQ ID NO: 800706 - protein, 515 aa, Homo sapiens
MEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEVQQGPRGSLGPPGFAATAAVPPRAGGGEGTKAQYLAAKALKKQSWRFHTKYMMWFQRHEEPKTITDEFEQVRAPPPLFPLLGLG

SEQ ID NO: 800707 - protein, 156 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTHGG

SEQ ID NO: 800708 - protein, 595 aa, Homo sapiens
HEAQDEGGHCWGSASGRRTLRRRRAAQRCGGGARADAGPMARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 800709 - protein, 595 aa, Homo sapiens; identical to SEQ ID NO: 800708

SEQ ID NO: 800710 - protein, 595 aa, Homo sapiens; identical to SEQ ID NO: 800708

SEQ ID NO: 800711 - protein, 468 aa, Homo sapiens
HEAQDEGGHCWGSASGRRTLRRRRAAQRCGGGARADAGPMARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYATRANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 800712 - protein, 121 aa, Homo sapiens
MHPPPGVWLLHLHTPLRGFCLPLPLRSQEAVPGRGRRHLSPQLLTPHPLTSSPFVKYTQDETCTQWLTAARFVTARGGEHRTPSEGEGISTARPPTHPRAGTRLSHKEVRSSDPGHSADAP

SEQ ID NO: 800713 - protein, 131 aa, Homo sapiens
MSRSVRDTRHRRVRCDPTSVFWVKGTMSAEGSCGWKRGGSITGVGSYPEGRDLGNPGTAMTPPRLFLGCGLLLAGTQGVNDGDHAVGRMGAAHYPVTALQNLLQQASVALWCDSLWNLLMPTLSAGPGSER

SEQ ID NO: 800714 - protein, 480 aa, Homo sapiens
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 800715 - protein, 480 aa, Homo sapiens; identical to SEQ ID NO: 800714

SEQ ID NO: 800716 - protein, 473 aa, Homo sapiens
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRR

SEQ ID NO: 800717 - protein, 480 aa, Homo sapiens; identical to SEQ ID NO: 800714

SEQ ID NO: 800718 - protein, 538 aa, Homo sapiens
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRSFLAWRRGRGEDKGPGYSWIPTVLVQPPRPTSPFLWEAPLAWRCTRKKWSGAGTKPWPREDWGTH

SEQ ID NO: 800719 - protein, 527 aa, Homo sapiens
PPIAPPPPPLLLVEAWFNRPRADVGEGAAVRERDAGCPARGGGPRRLPPRHPRRPGQGTLRGARGWGARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 800720 - protein, 196 aa, Homo sapiens [sequence omitted]

SEQ ID NO: 800721 - protein, 581 aa, Homo sapiens
LSTGLALTSVVGVASAWWAWFSAGERAHRTKGRVPPPRSGSGRDLRVGRAGIVRWAGPGLRVAEDLSGAWQLARGGVSASRGKWAVGGSHKQFKSSLGRGFEAGAGARGLPQLSAGTLTSSSWDPFSPARGPSPRSCLTVTTKPPCWPGALPPAGLEPRIRGQPRPKNLPSPKSPPQGVLTPDGGAAARVHEPEEAGSDGGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 800722 - protein, 568 aa, Homo sapiens
LLLLDLLRAHLIGFRLLVRPQLLHVLLLLSLGLIQVPLLFRWLQLAPLGAQHLGDLGKGQIRVARADLLAPLVQEAHVARDRCLGPIRQNLLPLLALGPAAFLHRLLLVGPLLARAWTLAALLLDSHHEAPMLARSLAARRPGAKDTAVSPVPRISPPPKAQPQGVLTPDGGAAARVHEPEEAGSDGGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 800723 - protein, 538 aa, Homo sapiens; identical to SEQ ID NO: 800718

SEQ ID NO: 800724 - protein, 106 aa, Homo sapiens
VQNPHAYILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 800725 - protein, 175 aa, Homo sapiens
MCPHLLAVGQQGAPGSPRAVSPWPRWPCPPGLPRTHPAPSLTVFLAPDWPVFPQRAPPPGAGGLVLGRDDGVMPGGLPQVLGVGCGGAGAGGHSCPPLAGPLPRAGGGALTRWHAALTVLVAAVPAVVGLAEGAGRGPWQVVPGFPGVRVGQACVPQLGRLRPVPWACTSSVWPA

SEQ ID NO: 800726 - protein, 68 aa, Homo sapiens
VLVFETDLRSVAQAGVQWCDSWIPTVLVQPPRPTSPFLWEAPLAWRCTRKKWSGAGTKPWPREDWGTH

SEQ ID NO: 800727 - protein, 99 aa, Homo sapiens
LSPGAISLGDPDCRPSLLRDCVHAGGVSICASVSLSPPSMSSPWEPWLVRDSPATDHSAFHRHRLRPAVLPLHLQPLPGLWGGHARVGCPPLLRPVHRD

SEQ ID NO: 800728 - protein, 143 aa, Homo sapiens
MVLADAAKMRSPRVRMAPNPVPGTLIRRGKLGRRQEGRVKTEAETGGQGVPGVAQSHHGLQEVWDRLSQPQKGPAPHRPGFQRANISVAEAPSAFAVLGDGRRHICSWPVSRSVAPTVSGHWPEGNRKSWRGRHTHEPFRNNE

SEQ ID NO: 800729 - protein, 480 aa, Homo sapiens; identical to SEQ ID NO: 800714

SEQ ID NO: 800730 - protein, 480 aa, Homo sapiens; identical to SEQ ID NO: 800714

SEQ ID NO: 800731 - protein, 480 aa, Homo sapiens; identical to SEQ ID NO: 800714

SEQ ID NO: 800732 - protein, 501 aa, Homo sapiens
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRCESWPTPPSPDTDPHSLMPFPPLPCRGP

SEQ ID NO: 800733 - protein, 473 aa, Homo sapiens; identical to SEQ ID NO: 800716

SEQ ID NO: 800734 - protein, 537 aa, Homo sapiens
MLQKFNFRGAGAPKVQDGTRPQRVDPQPLVHGVGCGRAAPLVQEAHVARDRCLGPIRQNLLPLLALGPAAFLHRLLLVGPLLARAWTLAALLLDSHHEAPMLARSLAARRPGAKDTAVSPVPRISPPPKAQPQGVLTPDGGAAARVHEPEEAGSDEGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 800735 - protein, 423 aa, Homo sapiens
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNNSGAFVYGSMSFLDKVANGLAVMAIQSLHPCPSELCCRACVSFYHWAMVAVTGGVGVAAALCLCSLLLWPTRLRRWDRDARP

SEQ ID NO: 800736 - protein, 196 aa, Homo sapiens [sequence omitted]

SEQ ID NO: 800737 - protein, 393 aa, Homo sapiens
MLQKFNFRGAGAPKVQDGTRPQRVDPQPLVHGVGCGRAAPLVQEAHVARDRCLGPIRQNLLPLLALGPAAFLHRLLLVGPLLARAWTLAALLLDSHHEAPMLARSLAARRPGAKDTAVSPVPRISPPPKAHPRAFGPPTAGLQRECMSPRRQGLMGLECSHRISAHCNLELLGSSDSPASASEQLGPQNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNNSGAFVYGSMSFLDKVANGLAVMAIQSLHPCPSELCCRACVSFYHWAMVAVTGGVGVAAALCLCSLLLWPTRLRRWDRDARP

SEQ ID NO: 800738 - protein, 175 aa, Homo sapiens; identical to SEQ ID NO: 800725

SEQ ID NO: 800739 - protein, 150 aa, Homo sapiens
GCSLDSAWPSHCTLVLGTKGGAAGHSFPALGNVRAGETEASTGFLEATQCGSGWNHLSVRGSPGLSDGVATWGGSDPGSWRLVESLPACPARYAFTVVANITVYGAAWLLLHLQGSSRVEPTQDISISDQLGGQDVPVFRVSWSPGGSPE

SEQ ID NO: 800740 - protein, 222 aa, Homo sapiens
TLERSRSTCIVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 800741 - protein, 411 aa, Homo sapiens
MTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 800742 - protein, 447 aa, Homo sapiens
HKIVYEVRPRVVNSSEGIRVFIYNVGNYHYDIQTDNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 800743 - protein, 411 aa, Homo sapiens; identical to SEQ ID NO: 800741

SEQ ID NO: 800744 - protein, 470 aa, Homo sapiens
NEYGSYRACDFSYMRHLAGLFRALLGEKILLFTTDGPEGLKCGSLRGLYTTVDFGPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 800745 - protein, 774 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800746 - protein, 317 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVRRKATPLKFGRDDGQPFA

SEQ ID NO: 800747 - protein, 79 aa, Homo sapiens
MVDPAINWFFLKMNGELEQTKDKREQAQNELSAWKFTPDSQTGKKLMAKCRMLIQENQELGRQLSQERMAQLVEIRVPS

SEQ ID NO: 800748 - protein, 996 aa, Homo sapiens
MESHSVDKAGLKLLTSSDPSASASQGAFTGVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800749 - protein, 683 aa, Homo sapiens
MPSELDLTQKMFPGTWFPHRRCLSEPENSDSKMGLMLWAVFTLHLGFLLALSSTGEWGRDEEPPWVEGGEGMFCPPQVSCSLSLMPRLPSIRHWQGPSHPGFLGPLFPICSLQWPHGFSAIFPGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800750 - protein, 970 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800751 - protein, 970 aa, Homo sapiens; identical to SEQ ID NO: 800750

SEQ ID NO: 800752 - protein, 774 aa, Homo sapiens; identical to SEQ ID NO: 800745

SEQ ID NO: 800753 - protein, 970 aa, Homo sapiens; identical to SEQ ID NO: 800750

SEQ ID NO: 800754 - protein, 239 aa, Homo sapiens
MPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800755 - protein, 970 aa, Homo sapiens; identical to SEQ ID NO: 800750

SEQ ID NO: 800756 - protein, 923 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQVRCV

SEQ ID NO: 800757 - protein, 969 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVGGAEKSTVMRLGEGGPSRTGTRGYTPPPPYGKADQIWLLSHKGRGEDMGIARTTPREN

SEQ ID NO: 800758 - protein, 360 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKCEGQGVGWGRPCQEGSQHCWGWVEGWMVKIGI

SEQ ID NO: 800759 - protein, 277 aa, Homo sapiens
MPHQVLYTKTVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVRRKATPLKFGRDDGQPFA

SEQ ID NO: 800760 - protein, 629 aa, Homo sapiens
MFCPPQVSCSLSLMPRLPSIRHWQGPSHPGFLGPLFPICSLQWPHGFSAIFPGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPASVFREALGIYRWSEPSEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800761 - protein, 970 aa, Homo sapiens; identical to SEQ ID NO: 800750

SEQ ID NO: 800762 - protein, 1118 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKCEGQGVGWGRPCQEGSQHCWGWVEGWMVKIGTDALAYATHHEGLALDHLLLTLSGEADSIVPILKMRKESEVCKVICPIHGSMDWYMKVLGLSSAAVYGVLWVSHFTDQNLVSSVQLGKSWSRCDDFTVPREEDWMESDLPKEDLPLPDSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800763 - protein, 962 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRVSKTQEVGVGSGSILGTRWTRVGMLALPLQCRWPWAGCLASLSLIFLMYAVGTVTPTLQGGYVGEEWYKQLWEYTKLWDVHFRRLGFMAYQLYLDGLLSCFQVAYVRPKHSCLGCIDLWHMEPVWFRAASCLQPGAFSSPC

SEQ ID NO: 800764 - protein, 970 aa, Homo sapiens; identical to SEQ ID NO: 800750

SEQ ID NO: 800765 - protein, 725 aa, Homo sapiens
VPRRPLEHETAPEQQEGIDRMAWQSRKGGHFREVAMQWKVTLTSRWGLLRHCQVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800766 - protein, 349 aa, Homo sapiens
MLQVPALSPHPCRSVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 800767 - protein, 83 aa, Homo sapiens
AAAPTSVLDVAWNPRPTDALGTGLWVKAGAVTVVHVHLEHCGNRLVVTKSGLRNIRATFHYLHRSNSAAVMTVCHYTGDPNST

SEQ ID NO: 800768 - protein, 923 aa, Homo sapiens; identical to SEQ ID NO: 800756

SEQ ID NO: 800769 - protein, 494 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQVRDGVSRRQVLLLDPQSLPDLPAPVQVLIRSLWFLLILFLIDK

SEQ ID NO: 800770 - protein, 246 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQVCAKWG

SEQ ID NO: 800771 - protein, 1548 aa, Homo sapiens
MLRARPEALMLLGALLTGSLGPSGSQDALSLPWEVQRYDGWFNNLRHHERGAVGCRLQRRVPANYADGVYQALEEPQLPNPRRLSNAATRGIAGLPSLHNRTVLGVFFGYHVLSDVVSVETPGCPAEFLNIRIPPGDPVFDPDQRGDVVLPFQRSRWDPETGRSPSNPRDLANQVTGWLDGSAIYGSSHSWSDALRSFSGGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISPEFVVASEQFFSTMVPPGVYMRNASCHFRKVLNKGFQSSQALRVCNNYWIRENPNLNSTQEVNELLLGMASQISELEDNIVVEDLRDYWPGPGKFSRTDYVASSIQRGRDMGLPSYSQALLAFGLDIPRNWSDLNPNVDPQVLEATAALYNQDLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFALPPSDIAQTTLVGIILSRGTAASVSFMFSYILLTMCRNLITFLRETFLNRYVPFDAAVDFHRWIAMAAVVLAILHSAGHAVNVYIFSVSPLSLLACIFPNVFVNDGSKLPQKFYWWFFQTVPGMTGVLLLLVLAIMYVFASHHFRRRSFRGFWLTHHLYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLSLHIRAVGPWTTRLREIYSSPKGNGCAGYPKLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 800772 - protein, 333 aa, Homo sapiens
RARSCYIRVYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLSLHIRAVGPWTTRLREIYSSPKGNGCAGYPKLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 800773 - protein, 124 aa, Homo sapiens
LSPCCSRPESFYKTNHEILLIHFVPCPLPGTRSHSLPLPHALPRELFSWLQRQGENSPISFSQLPPPGTGAPCPRSPRAGRPWTEEEVWQKVSVSQIPGPKETWREVLGSLGPTHISLTYKRPS

SEQ ID NO: 800774 - protein, 1548 aa, Homo sapiens; identical to SEQ ID NO: 800771

SEQ ID NO: 800775 - protein, 194 aa, Homo sapiens
PQGFEYKSGQWVRIACLALGTTEYHPFTLTSAPHEDTLSLHIRAVGPWTTRLREIYSSPKGNGCAGYPKVPVTGNPASGPLALAEDLCPSLPETRSSSRPKASLGEDRGASEKTRMFCILPLPVSPFLVSELGQGQAHFISPLSWQLYLDGPFGEGHQEWHKFEVSVLVGGGIGVTPFASILKDLVFKSSLGSQ

SEQ ID NO: 800776 - protein, 122 aa, Homo sapiens
GHACHADCDSELFQAPSEPERGSGKSQETPRQCHVAVKPLVPICQGAKPQDCWWDVGTTPFSFSSYNRMAERKGPSGIFQFSQPILQRWRLRPEACPRRLHMTQQSSPLWHQHFFQPQERKV

SEQ ID NO: 800777 - protein, 224 aa, Homo sapiens
MGIMAASRPLSRFWEWGKNIVCVGRNYADHVREMRSAVLSEPVLFLKPSTAYAPEGSPILMPAYTRNLHHELELGVVMGKRCRAVPEAAAMDYVGGYALCLDMTARDVQDECKKKGLPWTLAKSFTASCPVSAFVPKEKIPDPHKLKLWLKVNGELRQEGETSSMIFSIPYIISYVSKIITLEEGDIILTGTPKGVGPVKENDEIEAGIHGLVSMTFKVEKPEY

SEQ ID NO: 800778 - protein, 224 aa, Homo sapiens; identical to SEQ ID NO: 800777

SEQ ID NO: 800779 - protein, 224 aa, Homo sapiens; identical to SEQ ID NO: 800777

SEQ ID NO: 800780 - protein, 286 aa, Homo sapiens
MADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKSWRESCDSALRAYVKDHYSNGFCTVYAKTIDGQQTIIACIESHQFQPKNFWNGRWRSEWKFTITPPTAQVVGVLKIQVHYYEDGNVQLVSHKDVQDSLTVSNEAQTAKEFIKIIENAENEYQTAISENYQTMSDTTFKALRRQLPVTRTKIDWNKILSYKIGKEMQNA

SEQ ID NO: 800781 - protein, 308 aa, Homo sapiens
LCSRVVIGINQTNRSTNQEQPKMADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKSWRESCDSALRAYVKDHYSNGFCTVYAKTIDGQQTIIACIESHQFQPKNFWNGRWRSEWKFTITPPTAQVVGVLKIQVHYYEDGNVQLVSHKDVQDSLTVSNEAQTAKEFIKIIENAENEYQTAISENYQTMSDTTFKALRRQLPVTRTKIDWNKILSYKIGKEMQNA

SEQ ID NO: 800782 - protein, 286 aa, Homo sapiens; identical to SEQ ID NO: 800780

SEQ ID NO: 800783 - protein, 177 aa, Homo sapiens
MADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKSWRESCDSALRAYVKDHYSNGFCTVYAKTIDGQQTIIACIESHQFQPKNFCYSPGGWRA

SEQ ID NO: 800784 - protein, 138 aa, Homo sapiens
LLVYTFNNSLCPSIVLALNFWNGRWRSEWKFTITPPTAQVVGVLKIQVHYYEDGNVQLVSHKDVQDSLTVSNEAQTAKEFIKIIENAENEYQTAISENYQTMSDTTFKALRRQLPVTRTKIDWNKILSYKIGKEMQNA

SEQ ID NO: 800785 - protein, 286 aa, Homo sapiens; identical to SEQ ID NO: 800780

SEQ ID NO: 800786 - protein, 286 aa, Homo sapiens; identical to SEQ ID NO: 800780

SEQ ID NO: 800787 - protein, 286 aa, Homo sapiens; identical to SEQ ID NO: 800780

SEQ ID NO: 800788 - protein, 136 aa, Homo sapiens
MADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKHVKKRKVFVLPFCFCSVI

SEQ ID NO: 800789 - protein, 168 aa, Homo sapiens
SVKAESWGTGTEKISKVEERVSRLGLPVLSWGREGADSSAYSGGTGLRCDPEVLPLPNEMRVTFHTAPPPGVGKATDRSSCRAALKALDSAVVEITGTRKTCRSSNSYLVGWRPEAKNNRNTLPAPIRWMGNECNSLGKILDFKSPKANPTSWGAGAGAGVRRRHSRA

SEQ ID NO: 800790 - protein, 286 aa, Homo sapiens; identical to SEQ ID NO: 800780

SEQ ID NO: 800791 - protein, 286 aa, Homo sapiens; identical to SEQ ID NO: 800780

SEQ ID NO: 800792 - protein, 286 aa, Homo sapiens; identical to SEQ ID NO: 800780

SEQ ID NO: 800793 - protein, 286 aa, Homo sapiens; identical to SEQ ID NO: 800780

SEQ ID NO: 800794 - protein, 286 aa, Homo sapiens; identical to SEQ ID NO: 800780

SEQ ID NO: 800795 - protein, 265 aa, Homo sapiens
MADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKSWRESCDSALRAYVKDHYSNGFCTVYAKTIDGQQTIIACIESHQFQPKNFWNGRWRSEWKFTITPPTAQVVGVLKIQVHYYEDGNVQLVSHKDVQDSLTVSNEAQTAKEFIKIIENAENEYQTAISENYQTMSDTTYLKRISGDTLE

SEQ ID NO: 800796 - protein, 90 aa, Homo sapiens
SLKIIYPVYPSQGTQAYPLTIALLFCSQPAPFLFKQLIFNYLLQTAISENYQTMSDTTFKALRRQLPVTRTKIDWNKILSYKIGKEMQNA

SEQ ID NO: 800797 - protein, 269 aa, Homo sapiens
ADGNPAAIAMSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRRQACLVAVENAWRKAQEVCNLVGQTLGKPLLIKEEETKEWEGQIDDHQSSRLSSSLTVQQKIKSATIHAASKVFITFEVKGKEKRKKHL

SEQ ID NO: 800798 - protein, 137 aa, Homo sapiens
MEAEVCITFTEFGKMQNICNFLVEKLDSSVVISPPQFYHTPGSVENLRRQACLVAVENAWRKAQEVCNLVGQTLGKPLLIKEEETKEWEGQIDDHQSSRLSSSLTVQQKIKSATIHAASKVFITFEVKGKEKRKKHL

SEQ ID NO: 800799 - protein, 138 aa, Homo sapiens
ADGNPAAIAMSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEFH

SEQ ID NO: 800800 - protein, 144 aa, Homo sapiens
ADGNPAAIAMSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEKLLRRGGV

SEQ ID NO: 800801 - protein, 266 aa, Homo sapiens
ADGNPAAIAMSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRRQACLVAVENAWRKAQEVCNLVGQTLGKPLLIKEEETKEWEGQIDDHQSSRLSSSLTVQQKIKSATIHAASKVFITFEKLLRRGGV

SEQ ID NO: 800802 - protein, 266 aa, Homo sapiens; identical to SEQ ID NO: 800801

SEQ ID NO: 800803 - protein, 266 aa, Homo sapiens; identical to SEQ ID NO: 800801

SEQ ID NO: 800804 - protein, 194 aa, Homo sapiens
ADGNPAAIAMSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRNCTFLRKYLCKVFH

SEQ ID NO: 800805 - protein, 266 aa, Homo sapiens; identical to SEQ ID NO: 800801

SEQ ID NO: 800806 - protein, 196 aa, Homo sapiens
ADGNPAAIAMSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRNSWNPSSTSQPTITPR

SEQ ID NO: 800807 - protein, 266 aa, Homo sapiens; identical to SEQ ID NO: 800801

SEQ ID NO: 800808 - protein, 266 aa, Homo sapiens; identical to SEQ ID NO: 800801

SEQ ID NO: 800809 - protein, 266 aa, Homo sapiens; identical to SEQ ID NO: 800801

SEQ ID NO: 800810 - protein, 725 aa, Homo sapiens
NASRAGMRSAEGEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVVS

SEQ ID NO: 800811 - protein, 780 aa, Homo sapiens
NASRAGMRSAEGEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSVKRTVETLLSLGAHSEESSFVCLSLQLLGFVAFYCTVMLTLCVLYYWLFPAR

SEQ ID NO: 800812 - protein, 780 aa, Homo sapiens; identical to SEQ ID NO: 800811

SEQ ID NO: 800813 - protein, 790 aa, Homo sapiens
NASRAGMRSAEGEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 800814 - protein, 790 aa, Homo sapiens; identical to SEQ ID NO: 800813

SEQ ID NO: 800815 - protein, 565 aa, Homo sapiens
NASRAGMRSAEGEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKVSRLNDAVQAADWLTAYLFGQARWFLLSIKMSTIFLSVRNLD

SEQ ID NO: 800816 - protein, 750 aa, Homo sapiens
NASRAGMRSAEGEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQLPVSVAEFTALTASSWPGAVAHACNPSTLGGRGGWIT

SEQ ID NO: 800817 - protein, 388 aa, Homo sapiens
NASRAGMRSAEGEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGGKHNSGDS

SEQ ID NO: 800818 - protein, 214 aa, Homo sapiens
AVLDFVTQKASQSPQKQHPLLDGVDGECPFPSRRSQHTDDSALCMSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 800819 - protein, 241 aa, Homo sapiens
GRACAELAGPSVVGWEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEDLSRESPFRNLL

SEQ ID NO: 800820 - protein, 783 aa, Homo sapiens
GRACAELAGPSVVGWEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSVKRTVETLLSLGAHSEESSFVCLSLQLLGFVAFYCTVMLTLCVLYYWLFPAR

SEQ ID NO: 800821 - protein, 780 aa, Homo sapiens; identical to SEQ ID NO: 800811

SEQ ID NO: 800822 - protein, 132 aa, Homo sapiens
SCRIGTRGAALTDGVVLCHLANHVRPRSVPSIHVPSPAVPKLTMAKCRRNVENFLEACRKIGVPQDNLCSPSDILQLNLSVKRTVETLLSLGAHSEESSFVCLSLQLLGFVAFYCTVMLTLCVLYYWLFPAR

SEQ ID NO: 800823 - protein, 444 aa, Homo sapiens
NASRAGMRSAEGEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEVVHRLKPKYVAIPS

SEQ ID NO: 800824 - protein, 689 aa, Homo sapiens
NASRAGMRSAEGEMAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVVS

SEQ ID NO: 800825 - protein, 258 aa, Homo sapiens
MRRGTRIHGSEVKFVKMSTIPRHFGLKYKEESYMFKELEKVRQETKKDFLRFKQKLASKPAVDESPVHSLHAPGPARPARVSCAAARTSRRYPSLKGPAMSAAALLQEVLGGAPRPSGLGEAAAPGKTRSFRPRDFYLRSSAFLRHQALKKPPVIASGFGTARPVVLLPPPEPPVKRRARGVLESSRHAAPRRVFHLGREREQSQEVAPLAGPCMAKERKASSVSAEDGYMEASSGRRKVRIRSNFVSESGAREAREA

SEQ ID NO: 800826 - protein, 285 aa, Homo sapiens
ASRAHPAPRHRKGLLDTRRAAGPSSPPPELERRRPRCRVKFVKMSTIPRHFGLKYKEESYMFKELEKVRQETKKDFLRFKQKLASKPAVDESPVHSLHAPGPARPARVSCAAARTSRRYPSLKGPAMSAAALLQEVLGGAPRPSGLGEAAAPGKTRSFRPRDFYLRSSAFLRHQALKKPPVIASGFGTARPVVLLPPPEPPVKRRARGVLESSRHAAPRRVFHLGREREQSQEVAPLAGPCMAKERKASSVSAEDGYMEASSGRRKVRIRSNFVSESGAREAREA

SEQ ID NO: 800827 - protein, 177 aa, Homo sapiens
PPRGQLARKSACFLSHPLVHTLPNTTPYLTFLLTSAADHTLVMDKLLSTVPPTQPPCPGHEVFASLIWSIWPLLESCQMRDISFTWRRMGRSQHLTSATLPQNQCHPSPAHPNLVSYIIPQLHQDLVEEELRGSSRLTCILKYAFCPVLISSPSTSAGGMGASAGRPACWSPSLQST

SEQ ID NO: 800828 - protein, 102 aa, Homo sapiens
MRRQRDISFTWRRMGRSQHLTSATLPQNQCHPSPAHPNLVSYIIPQLHQDLVEEELRGSSRLTCILKYAFCPVLISSPSTSAGGMGASAGRPACWSPSLQST

SEQ ID NO: 800829 - protein, 133 aa, Homo sapiens
MRKHVLAASFSMLSLLVIMGDTDSKTDSSFIMDSDPRRCMRHHYVDSISHPLYKCSSKMVLLARCEGHCSQASRSEPLVSFSTVLKQPFRSSCHCCRPQTSKLKALRLRCSGGMRLTATYRYILSCHCEECNS

SEQ ID NO: 800830 - protein, 133 aa, Homo sapiens; identical to SEQ ID NO: 800829

SEQ ID NO: 800831 - protein, 209 aa, Homo sapiens
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAELRYDLPASYKFHKKKSVDIEVDLIRFSF

SEQ ID NO: 800832 - protein, 209 aa, Homo sapiens; identical to SEQ ID NO: 800831

SEQ ID NO: 800833 - protein, 209 aa, Homo sapiens; identical to SEQ ID NO: 800831

SEQ ID NO: 800834 - protein, 215 aa, Homo sapiens
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAGGFCFTELRYDLPASYKFHKKKSVDIEVDLIRFSF

SEQ ID NO: 800835 - protein, 209 aa, Homo sapiens; identical to SEQ ID NO: 800831

SEQ ID NO: 800836 - protein, 198 aa, Homo sapiens
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAELRYDLPASYKFHKKKSV

SEQ ID NO: 800837 - protein, 186 aa, Homo sapiens
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTRENFDMTCQHHTSFTKRNQWTLKWT

SEQ ID NO: 800838 - protein, 209 aa, Homo sapiens; identical to SEQ ID NO: 800831

SEQ ID NO: 800839 - protein, 30 aa, Homo sapiens
MTRKSRRPMLNNAGRDIIKAKSSVRIPFAP

SEQ ID NO: 800840 - protein, 138 aa, Homo sapiens [sequence omitted]

SEQ ID NO: 800841 - protein, 96 aa, Homo sapiens
GRLQLREGRPLPAAGSAASLRLWPGAALTVGHELHDEPRAQPYTRTWSLHQYQPETIVSPRSSAGHGRSPVTGCRSRPRAPRPCPPRPSLVGEPLP

SEQ ID NO: 800842 - protein, 941 aa, Homo sapiens
MYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRNKPAHTSWNMGAILEGKRSGFAPCGPKEQLSMEMILKAEEGNHEWICRILKDNFASADVADAKGYTVLAAAATHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKLDLLPSSLKLSNEPGPPQAYYSTDTALPEEGGRTALHMACEREDDNKCARDIVRLLLSHGANPNLLWSGHSPLSLSIASGNELVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 800843 - protein, 769 aa, Homo sapiens
GLSPGKRDALRRRRAGKQSGRERGRPRWLQSRRSPCCPARALRVLLGWKTTDMEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 800844 - protein, 221 aa, Homo sapiens
RLHGGARGLQVRQQVLSRVVEHGHAQLCHAGRARAGLLAGDVDAQRDSRARQLLLRARELARSRGRVRARRAPTVEVRARRPRGAQLLPVPWRPPKSLLLGPEDLFWGLRRPPRSLFVGAGRAAGRPRVLEASEVDQAGVLGPPRALGRDRGLGSRWGRGMAGGLGLTRAPGPWTALRPMFSVPGRRPPRPRGLWHWACVCGSWAQRPARSTAASGAEASA

SEQ ID NO: 800845 - protein, 522 aa, Homo sapiens
MYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRNKPAHTSWNMGAILEGKRSGFAPCGPKEQLSMEMILKAEEGNHEWICRILKDNFASADVADAKGYTVLAAAATHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIE

SEQ ID NO: 800846 - protein, 941 aa, Homo sapiens; identical to SEQ ID NO: 800842

SEQ ID NO: 800847 - protein, 292 aa, Homo sapiens
MYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIE

SEQ ID NO: 800848 - protein, 139 aa, Homo sapiens
EKTEREPGYQADCLVTPLGASVADSNSRMPGIPEFCHSPGWSPFIANQAWWLSLKGIPSGSGRAAISHQLLHLTVIPWAVLPGPLPWPGYLHVARWLQFHGHILPQPPRRLRHHVHEDTAFPGEGAAMCSAGVEVAVCV

SEQ ID NO: 800849 - protein, 573 aa, Homo sapiens
EKTEREPGYQADCLVTPLGASVADSNSRMPGIPEFCHSPGWSPFIANQAWWLSLKGIPSGSGRAAISHQLPISQSYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRNKPAHTSWNMGAILEGKRSGFAPCGPKEQLSMEMILKAEEGNHEWICRILKDNFASADVADAKGYTVLAAAATHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIE

SEQ ID NO: 800850 - protein, 101 aa, Homo sapiens
LCSPQPGLTAPHEAQATAFPLLGRGEMRLLQGSPELAICRSLALLPTSLPCLASVSPLGDVSLQVPSPASDDAAAPGAAGGGQVTGQHLPLPKSPAVAGVH

SEQ ID NO: 800851 - protein, 321 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 800852 - protein, 352 aa, Homo sapiens
MAVWSPLVMPGRREGCCHTPVTNEETEAREAKGQKLRPCHTLGVHVRLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 800853 - protein, 329 aa, Homo sapiens
MKEDCLPSSHVPISDSKSIQKSSLGVQEEGTLIIEGLLNIAWGLRRPIRLQMQDDREQVHLPSTSWMPRRPSCPLGCWSLLLGLSSLSLPAAISALQLSVFRKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 800854 - protein, 218 aa, Homo sapiens
MTGSRCTSPPPHGCPDGLAALWPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 800855 - protein, 370 aa, Homo sapiens
MAVWSPLVMPGRREGCCHTPVTNEETEAREAKGQKLRPCHTLGVHVRLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRFSPISKHRDLTSCDCLLQVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 800856 - protein, 238 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGEDRQDLPDGS

SEQ ID NO: 800857 - protein, 133 aa, Homo sapiens [sequence omitted]

SEQ ID NO: 800858 - protein, 133 aa, Homo sapiens [sequence omitted]

SEQ ID NO: 800859 - protein, 321 aa, Homo sapiens; identical to SEQ ID NO: 800851

SEQ ID NO: 800860 - protein, 158 aa, Homo sapiens
MAVWSPLVMPGRREGCCHTPVTNEETEAREAKGQKLRPCHTLGVHVRLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPS

SEQ ID NO: 800861 - protein, 107 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLLTLWFEIQASPQP

SEQ ID NO: 800862 - protein, 116 aa, Homo sapiens
AYGSVTNVRVNSTMTTLQVLTLLLNKFRVSLVRSSLAPGCQWSAILLGVGFWGKLPVAEAAWAEGLARVPLLSFGFSDFKQEEVGRGQVPCNLRVCYWGCSYCQGTLSVLSHLQAP

SEQ ID NO: 800863 - protein, 67 aa, Homo sapiens
AAAYYYYYCSEFKLLTMYAGHAVRNCVRANVTAGFPQPSSIITDTESCRGGLPTVLSTLPSSGSIDP

SEQ ID NO: 800864 - protein, 321 aa, Homo sapiens; identical to SEQ ID NO: 800851

SEQ ID NO: 800865 - protein, 333 aa, Homo sapiens
MKEDCLPSSHVPISDSKSIQKSELLGLLKTYNCYHEGKSFQLRHREEAQCHICACRAPEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 800866 - protein, 344 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGGFSRRIPPSYRKPPSPPLPEKWMERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 800867 - protein, 185 aa, Homo sapiens
MRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 800868 - protein, 133 aa, Homo sapiens [sequence omitted]

SEQ ID NO: 800869 - protein, 321 aa, Homo sapiens; identical to SEQ ID NO: 800851

SEQ ID NO: 800870 - protein, 280 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVSGGQGWGGLL

SEQ ID NO: 800871 - protein, 247 aa, Homo sapiens
MAVWSPLVMPGRREGCCHTPVTNEETEAREAKGQKLRPCHTLGVHVRLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRGRWPQ

SEQ ID NO: 800872 - protein, 130 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLHLAGKKGRLQPGGLPTPMQAEHVSPSLVLSLKFTRI

SEQ ID NO: 800873 - protein, 711 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 800874 - protein, 784 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKEVGGGGGRWDVLLRVRREEGSHGLKAGGWRARAEWSACLETFGRTSAGTPTAQRRPGASHCGPACARPFATRSGVVQTTCGPRVRPKLGGYRAGLEAWNRRAGARSRPDGCPHAATDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 800875 - protein, 541 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKEVGGGGGRWDVLLRVRREEGSHGLKAGGWRARAELERLLRDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNR

SEQ ID NO: 800876 - protein, 808 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKEVGGGGGRWDVLLRVRREEGSHGLKAGGWRARAELERLLRDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNREAQLPVSHREELRLCPLWLSHWGLGIYPCPQRSQPEDGRSSICPRSLLPVLIPHSSRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 800877 - protein, 799 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKEVGGGGGRWDVLLRVRREEGSHGLKAGGWRARAELERLLRDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSWGASLVFGDPVSSHLPPSPGKLTSEPWGNGLRVTNDLQSFSPSHMPLTGYEVWLGTLFQNPQHGEPSLQRVPVAKMVCGPSGSQLVLLKLERSVTLNQRVALICLPPEWYVVPPGTKCEIAGWGETKGKSTVHRTAGPRGRSGETRPAGPPGNPGPPGPPGPPGPGIDMYAFCCLGPREKGPDPLQYMRADPAGRCLRQHDPEVDATLKFLTTQIESIRRPRGFREPCVDLRL

SEQ ID NO: 800878 - protein, 751 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKEVGGGGGRWDVLLRVRREEGSHGLKAGGWRARAELERLLRDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 800879 - protein, 744 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQGEAQAWGLQSRAGSLEPEGRGEVSACWLPAPATDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 800880 - protein, 531 aa, Homo sapiens
VHAPLPPPGSSTKVWTTTIAGILTAPSGHGATLRIRRSSESSVTSPAAGPRHSPAKRPQLSAASAGRVRATGAQPIPPLRAYLASVGTRKSLISTDLRQKNTRASEVGGGGGRWDVLLRVRREEGSHGLKAGGWRARAEWSACFRDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 800881 - protein, 93 aa, Homo sapiens
KSTVHRTAGGQEAQPWIFLQDPLPLPIPLTAGTGNDTVLNVALLNVISNQECNIKHRGRVRESEMCTEGLLAPVGACEVGGRALGQPWKGMGG

SEQ ID NO: 800882 - protein, 296 aa, Homo sapiens
MIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEAALDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 800883 - protein, 396 aa, Homo sapiens
MESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEAALDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 800884 - protein, 296 aa, Homo sapiens; identical to SEQ ID NO: 800882

SEQ ID NO: 800885 - protein, 296 aa, Homo sapiens; identical to SEQ ID NO: 800882

SEQ ID NO: 800886 - protein, 463 aa, Homo sapiens
PSGHHLKNYKKRVAALEAAKAQHFPEPGTDKQKVCKQCHEVLTRGSSANASKWYHLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEAALDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 800887 - protein, 388 aa, Homo sapiens
MESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEAALDEASGFNIPAEQASRPWTQPRGAEPEAQDVDPRPEAEEEELPWCCICNEDATLRCAGCDGDLFCARCFRWVQVECSVRELKGCLDP

SEQ ID NO: 800888 - protein, 395 aa, Homo sapiens
PSGHHLKNYKKRVAALEAAKAQHFPEPGTDKQKVCKQCHEVLTRGSSANASKWYHLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPVTLQDYRLPDSDDDEDEETAIQRVLQQLTEEAALDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 800889 - protein, 142 aa, Homo sapiens
MNYDSQQPPLPPLPYAGCRRASGFPALGRGGTVPVGVWGGGAGQGREGRSWGEGPRGPGLGRRDLSSADPAVLGATMESRCYGCAVKFTLFKKEASLPSPRAAGPGRRGGKSAGLNVQRLGLTAPFQLCGFDEVIDPQFPFL

SEQ ID NO: 800890 - protein, 396 aa, Homo sapiens; identical to SEQ ID NO: 800883

SEQ ID NO: 800891 - protein, 456 aa, Homo sapiens
MNYDSQQPPLPPLPYAGCRRASGFPALGRGGTVPVGVCGAGQGREGKGGAGVRVQGAQDLAGVISALQTLRCWEPPWRYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEAALDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 800892 - protein, 296 aa, Homo sapiens; identical to SEQ ID NO: 800882

SEQ ID NO: 800893 - protein, 388 aa, Homo sapiens; identical to SEQ ID NO: 800887

SEQ ID NO: 800894 - protein, 228 aa, Homo sapiens [sequence omitted]

SEQ ID NO: 800895 - protein, 396 aa, Homo sapiens; identical to SEQ ID NO: 800883

SEQ ID NO: 800896 - protein, 322 aa, Homo sapiens
MESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPEVRSPSRGDSTSHHPRLSPKLMRTDQLKLGGGPFSVPRSCLCTET

SEQ ID NO: 800897 - protein, 107 aa, Homo sapiens
MIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPEPLHLAP

SEQ ID NO: 800898 - protein, 142 aa, Homo sapiens; identical to SEQ ID NO: 800889

SEQ ID NO: 800899 - protein, 321 aa, Homo sapiens
MLDLEVVPERSLGNEQWEFTLGMPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFNM

SEQ ID NO: 800900 - protein, 469 aa, Homo sapiens
MLDLEVVPERSLGNEQWEFTLGMPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFNIYHRCEFKIPLAIKKENADGQTETCTTYSKWDNIQELLGHPVEKPVVLHRSSSPNNTNPFGSTFCFGLQRMIFEVMQNNHIASVTLYGPPRYSSVHLWPAGASRGHRLQREAQSLSLDSWTQELSTNKEAGEVNPCPMHIGKTWGSFCD

SEQ ID NO: 800901 - protein, 497 aa, Homo sapiens
MPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGGKPSPSDSSGHQWQFIAINLPGSAIPPHFLESGSHRIVGLVLGCEGNILPLVFNLVGQFRNKPQGRCCQSLLPARLVYVSHFRCQSTMLFSSPPPPTVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFNIYHRCEFKIPLAIKKENADGQTETCTTYSKWDNIQELLGHPVEKPVVLHRSSSPNNTNPFGSTFCFGLQRMIFEVMQNNHIASVTLYGPPRPGSHLRTAELP

SEQ ID NO: 800902 - protein, 252 aa, Homo sapiens
MYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFNIYHRCEFKIPLAIKKENADGQTETCTTYSKWDNIQELLGHPVEKPVVLHRSSSPNNTNPFGSTFCFGLQRMIFEVMQNNHIASVTLYGPPRPGSHLRTAELP

SEQ ID NO: 800903 - protein, 527 aa, Homo sapiens
MPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGGKPSPSDSSGHQWQFIAINLPGSAIPPHFLESGSHRIVGLVLGCEGNILPLVFNLVGQFRNKPQGRCCQSLLPARLVYVSHFRCQSTMLFSSPPPPTVYNSAEQLFHLNFRGLSFSFQLDSWTEAPKYEPNFAHGLASLQIPHGATVKRMYIYSGNSLQDTKYSIRSMSFLLRPGLPGRKNQASAHSVSVPRAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFNIYHRCEFKIPLAIKKENADGQTETCTTYSKWDNIQELLGHPVEKPVVLHRSSSPNNTNPFGSTFCFGLQRMIFEVMQNNHIASVTLYGPPRPGSHLRTAELP

SEQ ID NO: 800904 - protein, 422 aa, Homo sapiens
MLDLEVVPERSLGNEQWEFTLGMPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFNIYHRCEFKIPLAIKKENADGQTETCTTYSKWDNIQELLGHPVEKPVVLHRSSSPNNTNPFGSTFCFGLQRMIFEVMQNNHIASVTLYGPPRPGSHLRTAELP

SEQ ID NO: 800905 - protein, 258 aa, Homo sapiens
MPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGGKPSPSDSSGHQWQFIAINLPGSAIPPHFLESGSHRIVGLVLGCEGNILPLVFNLVGQFRNKPQGRCCQSLLPARLVYVSHFRCQSTMLFSSPPPPTVYNSAEQLFHLNFRGLSFSFQLDSWTEAPKYEPNFAHGLASLQIPHGATVKRMYIYSGNSLQDTK

SEQ ID NO: 800906 - protein, 139 aa, Homo sapiens [sequence omitted]

SEQ ID NO: 800907 - protein, 422 aa, Homo sapiens; identical to SEQ ID NO: 800904

SEQ ID NO: 800908 - protein, 422 aa, Homo sapiens; identical to SEQ ID NO: 800904

SEQ ID NO: 800909 - protein, 296 aa, Homo sapiens
MLDLEVVPERSLGNEQWEFTLGMPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVALL

SEQ ID NO: 800910 - protein, 222 aa, Homo sapiens
MLDLEVVPERSLGNEQWEFTLGMPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGQ

SEQ ID NO: 800911 - protein, 131 aa, Homo sapiens [sequence omitted]

SEQ ID NO: 800912 - protein, 201 aa, Homo sapiens
MAATALLEAGLARVLFYPTLLYTLFRGKVPGRAHRDWYHRIDPTVLLGALPLRSLTRQLVQDENVRGVITMNEEYETRFLCNSSQEWKRLGVEQLRLSTVDMTGIPTLDNLQKGVQFALKYQSLGQCVYVHCKAGRSRSATMVAAYLIQVHKWSPEEAVRAIAKIRSYIHIRPGQLDVLKEFHKQITARATKDGTFVISKT

SEQ ID NO: 800913 - protein, 201 aa, Homo sapiens; identical to SEQ ID NO: 800912

SEQ ID NO: 800914 - protein, 137 aa, Homo sapiens
MAATALLEAGLARVLFYPTLLYTLFRGKVPGRAHRDWYHRIDPTVLLGALPLRSLTRQLVQDENVRGVITMNEEYETRFLCNSSQVHKWSPEEAVRAIAKIRSYIHIRPGQLDVLKEFHKQITARATKDGTFVISKT

SEQ ID NO: 800915 - protein, 201 aa, Homo sapiens; identical to SEQ ID NO: 800912

SEQ ID NO: 800916 - protein, 201 aa, Homo sapiens; identical to SEQ ID NO: 800912

SEQ ID NO: 800917 - protein, 151 aa, Homo sapiens
MAATALLEAGLARVLFYPTLLYTLFRGKVPGRAHRDWYHRIDPTVLLGALPLRSLTRQVSRAGEPGPLPRPRRSVPVGPLGSPPSLLSHLFASAAGTGRERARGDHHERGVRDEVPVQLFTGAQMESRGGCKSHRQDPVIHPHQAWPAGCS

SEQ ID NO: 800918 - protein, 378 aa, Homo sapiens
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLGNSKNFFFSKKTKVTTK

SEQ ID NO: 800919 - protein, 486 aa, Homo sapiens
MISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 800920 - protein, 378 aa, Homo sapiens; identical to SEQ ID NO: 800918

SEQ ID NO: 800921 - protein, 990 aa, Homo sapiens
SGGYGWLHFYAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 800922 - protein, 1048 aa, Homo sapiens
MCIPFRLRKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 800923 - protein, 272 aa, Homo sapiens
PRKRNLTQTLLPSQSTIGPETPGTKPSTTLAPRKTKRPGRRPRPRPRPKTTPSPEVPKSKPALEPATIQPEPLVPTTVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAAPKVPQRTHRPHPKPKTTLSPEELQTELVPATIFEPVSPIKEAPGTTFVPVTDLEPVTFRTEIPATTLAT

SEQ ID NO: 800924 - protein, 1074 aa, Homo sapiens
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 800925 - protein, 378 aa, Homo sapiens; identical to SEQ ID NO: 800918

SEQ ID NO: 800926 - protein, 242 aa, Homo sapiens
LASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAAPKVPQRTHRPHPKPKTTLSPEELQTELVPATIFEPVSPIKEAPGTTFVPVTDLEPVTFRTEIPATTLAT

SEQ ID NO: 800927 - protein, 66 aa, Homo sapiens
GAQMKTPCGHRNYKPDSSRGATVRADASGPSRHEQSGPGLSNVRAKPVLHPKTSSSPRNSPRPVRP

SEQ ID NO: 800928 - protein, 66 aa, Homo sapiens; identical to SEQ ID NO: 800927

SEQ ID NO: 800929 - protein, 81 aa, Homo sapiens
FRLPLRRGLTPEYILRRQTTEVFSREKFIFILFLLFFIDLKHGVLLCHAGWTTVAIYSGPSEMAGYLQEDYHEEGLVCSNV

SEQ ID NO: 800930 - protein, 380 aa, Homo sapiens
AAAIVRSRGGGGWWSLDHAVGGASGDGLPSPPDAGRKYVRGDFRPLRCSRPGCKAFFCRLFSQVPSACTSRTPLAPGPSVSARLTVGCDDMSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTPSSDAQDKQFGTWRLRVTPVDYLLGVADLTGELMRMCINSVGNGDIDTPFEVSQFLRQVYDGFSFIGNTGPYEVSKKLYTLKQSLAKVENACYALKVRGSEIPKHMLADVFSVKTEMIDQEEGIS

SEQ ID NO: 800931 - protein, 380 aa, Homo sapiens; identical to SEQ ID NO: 800930

SEQ ID NO: 800932 - protein, 380 aa, Homo sapiens; identical to SEQ ID NO: 800930

SEQ ID NO: 800933 - protein, 335 aa, Homo sapiens
ALVSTQSAHYAGGRLFSQVPSACTSRTPLAPGPSVSARLTVGCDDMSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTPSSDAQDKQFGTWRLRVTPVDYLLGVADLTGELMRMCINSVGNGDIDTPFEVSQFLRQVYDGFSFIGNTGPYEVSKKLYTLKQSLAKVENACYALKVRGSEIPKHMLADVFSVKTEMIDQEEGIS

SEQ ID NO: 800934 - protein, 103 aa, Homo sapiens
GLQARAEFGTSSSSPVMLAFKSFQQELDARHDKYERLVKLSRDITVESKRTIFLLHRITSAPDMEDILTESEIKLDGVRQKIFQDYRNMWKLSLFNTSSKHDH

SEQ ID NO: 800935 - protein, 297 aa, Homo sapiens
AAAIVRSRGGGGWWSLDHAVGGASGDGLPSPPDAGRKYVRGDFRPLRCSRPGCKAFFCRLFSQVPSACTSRTPLAPGPSVSARLTVGCDDMSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTPSSDAQDKQFGIYDSVKVYFRLPRPPPPEMPESLKKKLGLTQ

SEQ ID NO: 800936 - protein, 259 aa, Homo sapiens
AAAIVRSRGGGGWWSLDHAVGGASGDGLPSPPDAGRKYVRGDFRPLRCSRPGCKAFFCRLFSQVPSACTSRTPLAPGPSVSARLTVGCDDMSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTTVRI

SEQ ID NO: 800937 - protein, 110 aa, Homo sapiens
GASGDGLPSPPDAGRKYVRGDFRPLRCSRPGCKAFFCRLFSQVPSACTSRTPLAPGPSVSARLTVGCDDMSNKEGGVLNNTGRYLSGGGGSPVFLCSFPLFTLEGCLRPL

SEQ ID NO: 800938 - protein, 252 aa, Homo sapiens
ALVSTQSAHYAGGRLFSQVPSACTSRTPLAPGPSVSARLTVGCDDMSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTPSSDAQDKQFGIYDSVKVYFRLPRPPPPEMPESLKKKLGLTQ

SEQ ID NO: 800939 - protein, 380 aa, Homo sapiens; identical to SEQ ID NO: 800930

SEQ ID NO: 800940 - protein, 267 aa, Homo sapiens
AAAIVRSRGGGGWWSLDHAVGGASGDGLPSPPDAGRKYVRGDFRPLRCSRPGCKAFFCRLFSQVPSACTSRTPLAPGPSVSARLTVGCDDMSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTSHLSITFWEWLT

SEQ ID NO: 800941 - protein, 133 aa, Homo sapiens
FVFLPALLPSSDAQDKQFGTWRLRVTPVDYLLGVADLTGELMRMCINSVGNGDIDTPFEVSQFLRQVYDGFSFIGNTGPYEVSKKLYTLKQSLAKVENACYALKVRGSEIPKHMLADVFSVKTEMIDQEEGIS

SEQ ID NO: 800942 - protein, 220 aa, Homo sapiens
AAAIVRSRGGGGWWSLDHAVGGASGDGLPSPPDAGRKYVRGDFRPLRCSRPGCKAFFCRLFSQVPSACTSRTPLAPGPSVSARLTVGCDDMSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGKSRFVSG

SEQ ID NO: 800943 - protein, 88 aa, Homo sapiens
VLGVDTMEKLTILFRNLEEENLSSGHKVSHNEILLSFILQTKCWTHITTSFTRSTVDSRTTHSTRRTTGPRRAGNAKRTRFTLNRQRR

SEQ ID NO: 800944 - protein, 88 aa, Homo sapiens; identical to SEQ ID NO: 800943

SEQ ID NO: 800945 - protein, 76 aa, Homo sapiens
SRLFVETLQVRRFLYGMIFSNQLFESKRKRRSSVANGSHRKATPTAGFTRVESTLSLLLLVSRALQVQRNFSHNQL

SEQ ID NO: 800946 - protein, 144 aa, Homo sapiens
WVGSRLSHCEESKVWAMEMSLVLLFLIRTALFAPQGAAAEPHSLCYNLTVLSQDGSVQSGFLAEGHLDGQLFLLCDRQKGRAGPRGQWAEAVLGAETWDTETEDLTENGQELRRTLAHIKGQKGGRLHAKAMVISEILEVSEKQ

SEQ ID NO: 800947 - protein, 39 aa, Homo sapiens
ETWDTETEDLTENGQELRRTLAHIKGQKGGESGQWARVM

SEQ ID NO: 800948 - protein, 533 aa, Homo sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 800949 - protein, 337 aa, Homo sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKVCS

SEQ ID NO: 800950 - protein, 533 aa, Homo sapiens; identical to SEQ ID NO: 800948

SEQ ID NO: 800951 - protein, 329 aa, Homo sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTGARPGWRDGQAGQTEKNQKGWSGQMAEGMGGIWAMARAVQPHNGCFNWTSRARGRTGGLCSSGAGAGQRENPSLGCVSPLGQLWRGPRKRLV

SEQ ID NO: 800952 - protein, 141 aa, Homo sapiens
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFL

SEQ ID NO: 800953 - protein, 103 aa, Homo sapiens
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPLDCFR

SEQ ID NO: 800954 - protein, 904 aa, Homo sapiens [sequence omitted]

SEQ ID NO: 800955 - protein, 837 aa, Homo sapiens
YESDFDRRLSRVYTNDSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLISHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRDSETRVDLKFMYLDPPRDHHTLEIQQQALLREQQKRLNRIKMQEGAKVDLDAIPSAKVREQRMPRDDTSDFLKNSLLESDSAFIGAYGETYPAIEDDVLPPPSQLPSARERRRNKWKGLDIDSSRPNVAPDGLSLKSISSVNVDELRVRNEERMRRLNEFHNKPINTDDESSLVDPDDIMKHIGDDGSNSVATEPWLRPGTSETLKRFMAEQLNQEQQQIPGKPGTFTWQGLSTAHG

SEQ ID NO: 800956 - protein, 888 aa, Homo sapiens
YESDFDRRLSRVYTNDSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLITDLNRMHRQNIDAYHNPDARTYEDKRAVVSLDPNLATSNAENLEDAANKSSGHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRDSETRVDLKFMYLDPPRDHHTLEIQQQALLREQQKRLNRIKMQEGAKVDLDAIPSAKVREQRMPRDDTSDFLKNSLLESDSAFIGAYGETYPAIEDDVLPPPSQLPSARERRRNKWKGLDIDSSRPNVAPDGLSLKSISSVNVDELRVRNEERMRRLNEFHNKPINTDDESSLVDPDDIMKHIGDDGSNSVATEPWLRPGTSETLKRFMAEQLNQEQQQIPGKPGTFTWQGLSTAHG

SEQ ID NO: 800957 - protein, 653 aa, Homo sapiens
YESDFDRRLSRVYTNDSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLITDLNRMHRQNIDAYHNPDARTYEDKRAVVSLDPNLATSNAENLEDAANKSSGHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRGE

SEQ ID NO: 800958 - protein, 888 aa, Homo sapiens; identical to SEQ ID NO: 800956

SEQ ID NO: 800959 - protein, 993 aa, Homo sapiens
YESDFDRRLSRVYTNDSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLITDLNRMHRQNIDAYHNPDARTYEDKRAVVSLDPNLATSNAENLEDAANKSSGHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRDSETRVDLKFMYLDPPRDHHTLEIQQQALLREQQKRLNRIKMQEGAKVDLDAIPSAKVREQRMPRDDTSDFLKNSLLESDSAFIGAYGETYPAIEDDVLPPPSQLPSARERRRNKWKGLDIDSSRPNVAPDGLSLKSISSVNVDELRVRNEERMRRLNEFHNKPINTDDESSLVDPDDIMKHIGDDGSNSVATEPWLRPGTSETLKRFMAEQLNQEQQQIPGKPGTFTRAANKSSGHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEA

SEQ ID NO: 800960 - protein, 556 aa, Homo sapiens
YESDFDRRLSRVYTNDSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLITDLNRMHRQNIDAYHNPDARTYEDKRAVVSLDPNLATSNAENLEDAANKSSGHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSVEAVDGFNGT

SEQ ID NO: 800961 - protein, 302 aa, Homo sapiens
MHRNKRGNMPPMEHDGDVIEQSNIRISSAENKSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERGRETTDLQ

SEQ ID NO: 800962 - protein, 329 aa, Homo sapiens
MKLLRRAWRRRAALGLGTLALCGAALLYLARCAAEPGDPRAMSGRSPPPPAPARAAAFLAVLVASAPRAAERRSVIRSTWLARRGAPGDVWARFAVGTAGLGAEERRALEREQARHGDLLLLPALRDAYENLTAKVLAMLAWLDEHVAFEFVLKADDDSFARLDALLAELRAREPARRRRLYWGFFSGRGRVKPGGRWREAAWQLCDYYLPYALGGGYVLSADLVHYLRLSRDYLRAWHSEDVSLGAWLAPVDVQREHDPRFDTEYRSRGCSNQYLVTHKQSLEDMLEKHATLAREGRLCKREVQLRLSYVYDWSAPPSQCCQRREGIP

SEQ ID NO: 800963 - protein, 349 aa, Homo sapiens
SRRRLRTRESGLGRRPGAGAMKLLRRAWRRRAALGLGTLALCGAALLYLARCAAEPGDPRAMSGRSPPPPAPARAAAFLAVLVASAPRAAERRSVIRSTWLARRGAPGDVWARFAVGTAGLGAEERRALEREQARHGDLLLLPALRDAYENLTAKVLAMLAWLDEHVAFEFVLKADDDSFARLDALLAELRAREPARRRRLYWGFFSGRGRVKPGGRWREAAWQLCDYYLPYALGGGYVLSADLVHYLRLSRDYLRAWHSEDVSLGAWLAPVDVQREHDPRFDTEYRSRGCSNQYLVTHKQSLEDMLEKHATLAREGRLCKREVQLRLSYVYDWSAPPSQCCQRREGIP

SEQ ID NO: 800964 - protein, 329 aa, Homo sapiens; identical to SEQ ID NO: 800962

SEQ ID NO: 800965 - protein, 424 aa, Homo sapiens
SRRRLRTRESGLGRRPGAGAMKLLRRAWRRRAALGLGTLALCGAALLYLARCAAEPGDPRAMSGRSPPPPAPARAAAFLAVLVASAPRAAERRSVIRSTWLARRGAPGDVWARFAVGTAGLGAEERRALEREQARHGDLLLLPALRDAYENLTAKVLAMLAWLDEHVAFEFVLKADDDSFARLDALLAELRAREPARRRRLYWGFFSGRGRVKPGGRWREAAWQLCDYYLPYALGGGYVLSADLVHYLRLSRDYLRAWHSEDVSLGAWLAPVDVQREHDPRFDTEYRSRGCSNQYLVTHKQSLEDMLERARAACASARCSCACPTCTTGPRRPRSAAREGRASPEPPRPGPPGHLLHPAAPWGRCRAGALRPGPKAPVPQPRLWSLRPGLRLGDPWGLPGQRAVSRWRCPFLDLSEPEPGPAAR

SEQ ID NO: 800966 - protein, 329 aa, Homo sapiens; identical to SEQ ID NO: 800962

SEQ ID NO: 800967 - protein, 349 aa, Homo sapiens; identical to SEQ ID NO: 800963

SEQ ID NO: 800968 - protein, 111 aa, Homo sapiens
MPIIQSNQLVSSWVVKTLSLYFLLCLVNASAYGILQTTLKFREIQFQESTRRLCNSEDADTVFSYGSFHTSLFLYKKLRGWARPDQTLLFPVPLVLTPWNNGMKPRDLSAF

SEQ ID NO: 800969 - protein, 111 aa, Homo sapiens; identical to SEQ ID NO: 800968

SEQ ID NO: 800970 - protein, 157 aa, Homo sapiens
MVGRMKLLPNRIRTLALTAIGVVLLGVDDPGAPSDQVEVHLELDLPTQLTSVWQVMSTVPLAPLPGQLSLLGPPGALGFPQQGGPTQLPLLLREVGVEHKEHIGGRRCGGPRPALSSYPGHLLLQGPRALQPLGERPGHLQNHAAQGKGDLGQSDSE

SEQ ID NO: 800971 - protein, 382 aa, Homo sapiens
MAAADLSHGHYLSGDPVCLHEEKTPAGRIVADCLTDCYQDSVTFDDVAVDFTQEEWTLLDSTQRSLYSDVMLENYKNLATVGGQIIKPSLISWLEQEESGQFREEFSKEGKHNGRELCDCEQCGEVFSEHSCLKTHVRTQSTGNTHDCNQYGKDFLTLCEKTSTGEKLSEFNQSEKIFSLTPNIVYQRTSTQEKSFECSHCGKSFINESYLQAHMRTHNGEKLYEWRNYGPGFIDSTSLSVLIETLNAKKPYKCKECGKGYRYPAYLSIHMRTHTGEKPYECKECGKAFNYSNSFQIHGRTHTGEKPYVCKECGKAFTQYSGLSMHVRSHSGDKPYECKECGKSFLTSSRLIQHIRTHTGEKPLYVLNVGKPLQFPQILVDI

SEQ ID NO: 800972 - protein, 410 aa, Homo sapiens
MAAADLSHGHYLSGDPVCLHEEKTPAGRIVADCLTDCYQDSVTFDDVAVDFTQEEWTLLDSTQRSLYSDVMLENYKNLATVGGQIIKPSLISWLEQEESRTVQGGVLQGWEMRLETQWSILQQDFLRGQTSIGIQLEGKHNGRELCDCEQCGEVFSEHSCLKTHVRTQSTGNTHDCNQYGKDFLTLCEKTSTGEKLSEFNQSEKIFSLTPNIVYQRTSTQEKSFECSHCGKSFINESYLQAHMRTHNGEKLYEWRNYGPGFIDSTSLSVLIETLNAKKPYKCKECGKGYRYPAYLSIHMRTHTGEKPYECKECGKAFNYSNSFQIHGRTHTGEKPYVCKECGKAFTQYSGLSMHVRSHSGDKPYECKECGKSFLTSSRLIQHIRTHTGEKPLYVLNVGKPLQFPQILVDI

SEQ ID NO: 800973 - protein, 410 aa, Homo sapiens; identical to SEQ ID NO: 800972

SEQ ID NO: 800974 - protein, 284 aa, Homo sapiens
MAAADLSHGHYLSGDPVCLHEEKTPAGRIVADCLTDCYQDSVTFDDVAVDFTQEEWTLLDSTQRSLYSDVMLENYKNLATVGGQIIKPSLISWLEQEESRTVQGGVLQGWEMRLETQWSILQQDFLRGQTSIGIQLEGKHNGRELCDCEQCGEVFSEHSCLKTHVRTQSTGNTHDCNQYGKDFLTLCEKTSTGEKLSEFNQSEKIFSLTPNIVYQRTSTQEKSFECSHCGKSFINESYLQAHMRTHNGEKLYEWRNYGPGFIDSTSLSVLIETLNAKKPYKCKE

SEQ ID NO: 800975 - protein, 263 aa, Homo sapiens
MQGQNRTLGRRQVAGGYPASHPQQTLANPTLPASGSECLAGAAVEMIKVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQVPRLCGG

SEQ ID NO: 800976 - protein, 730 aa, Homo sapiens
MQGQNRTLGRRQVAGGYPASHPQQTLANPTLPASGSECLAGAAVEMIKVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQATCPSATPSSPTCCRIRLVVTARPSWWYRCPPWRRTLARRSIPSSLLRGCALWSWGLGYAGQSLGPGQARSI

SEQ ID NO: 800977 - protein, 730 aa, Homo sapiens; identical to SEQ ID NO: 800976

SEQ ID NO: 800978 - protein, 729 aa, Homo sapiens
MVLRMVEAMSQLQDEKTQLQEELVVLQERLALRDSDQQATSTQLQNQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQATCPSATPSSPTCCRIRLVVTARPSWWYRCPPWRRTLARRSIPSSLLRGCALWSWGLGYAGQSLGPGQARSI

SEQ ID NO: 800979 - protein, 648 aa, Homo sapiens
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQATCPSATPSSPTCCRIRLVVTARPSWWYRCPPWRRTLARRSIPSSLLRGCALWSWGLGYAGQSLGPGQARSI

SEQ ID NO: 800980 - protein, 729 aa, Homo sapiens; identical to SEQ ID NO: 800978

SEQ ID NO: 800981 - protein, 592 aa, Homo sapiens
SRGPPHVREVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQATCPSATPSSPTCCRIRLVVTARPSWWYRCPPWRRTLARRSIPSSLLRGCALWSWGLGYAGQSLGPGQARSI

SEQ ID NO: 800982 - protein, 250 aa, Homo sapiens
MEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQATCPSATPSSPTCCRIRLVVTARPSWWYRCPPWRRTLARRSIPSSLLRGCALWSWGLGYAGQSLGPGQARSI

SEQ ID NO: 800983 - protein, 335 aa, Homo sapiens
MQGQNRTLGRRQVAGGYPASHPQQTLANPTLPASGSECLAGAAVEMIKVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVQDKLLPLQPGTQSLNKDTMGTREMDRIQ

SEQ ID NO: 800984 - protein, 100 aa, Homo sapiens
ALGAPVAGPSAARPGTAAPLAAWCPEEAAEPQAMVPSRRTWNLGATPSLRGLWRVGRAPEPEPGMARPAPGPSQPGRPPFPTHRPGEVENWAWKRYPSLR

SEQ ID NO: 800985 - protein, 185 aa, Homo sapiens
ARVNHFLWKVCGRGASGLAEEEAAAWSCLLPAGRAGPSPGRCGDAWILPPPGRLPGAPRRLLSPRPWSPLAGRGTWEPRPRCGACGEWAGPRSPSRGWLAPPQAPASPAARPFPHTGPGRLRTGRGKDTPVCGDEDSSARSAARPALAQCRALSVDWAGPGSPHGLYLTLQRQGFTMLAMLLSKS

SEQ ID NO: 800986 - protein, 853 aa, Homo sapiens
ARVNHFLWKVCGRGASGLAEEEAAAWSCLLPAGRAGPSPGRCGDAWILPPPGRLPGAPRRLLSPRPWSPLAGRGTWEPRPRCGACGEWAGPRSPSRGWLAPPQAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQATCPSATPSSPTCCRIRLVVTARPSWWYRCPPWRRTLARRSIPSSLLRGCALWSWGLGYAGQSLGPGQARSI

SEQ ID NO: 800987 - protein, 769 aa, Homo sapiens
MVPCFQPYPPLASDRLLFHTAVPARLCGPMVKGEGSARVSQMRVPVLGPPLTGQVTSKLFSSSATEIWASLKSNSSFAICLRGLTAHVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQATCPSATPSSPTCCRIRLVVTARPSWWYRCPPWRRTLARRSIPSSLLRGCALWSWGLGYAGQSLGPGQARSI

SEQ ID NO: 800988 - protein, 648 aa, Homo sapiens; identical to SEQ ID NO: 800979

SEQ ID NO: 800989 - protein, 648 aa, Homo sapiens; identical to SEQ ID NO: 800979

SEQ ID NO: 800990 - protein, 124 aa, Homo sapiens
MAGVRHCCPALPPGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 800991 - protein, 458 aa, Homo sapiens
ARVNHFLWKVCGRGASGLAEEEAAAWSCLLPAGRAGPSPGRCGDAWILPPPGRLPGAPRRLLSPRPWSPLAGRGTWEPRPRCGACGEWAGPRSPSRGWLAPPQAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVQDKLLPLQPGTQSLNKDTMGTREMDRIQ

SEQ ID NO: 800992 - protein, 231 aa, Homo sapiens
QCECMCASACKDTAAWCPEEAAEPQAMVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQQALQDKGCKSQSQGTKEEKLWKRQAPAPRRAREAREAGGTMNVENTGKAGLPAKPALPSEASAGGRLLCSWYIPMPCPARLEVAETDSSCLIRSCIPQPA

SEQ ID NO: 800993 - protein, 274 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEG

SEQ ID NO: 800994 - protein, 957 aa, Homo sapiens; identical to SEQ ID NO: 766037

SEQ ID NO: 800995 - protein, 957 aa, Homo sapiens; identical to SEQ ID NO: 766037

SEQ ID NO: 800996 - protein, 274 aa, Homo sapiens; identical to SEQ ID NO: 800993

SEQ ID NO: 800997 - protein, 262 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEEEYQAGIFNSFGGSLPEEEND

SEQ ID NO: 800998 - protein, 957 aa, Homo sapiens; identical to SEQ ID NO: 766037

SEQ ID NO: 800999 - protein, 978 aa, Homo sapiens; identical to SEQ ID NO: 766035

SEQ ID NO: 801000 - protein, 283 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGIIFSLPFS

SEQ ID NO: 801001 - protein, 181 aa, Homo sapiens
SSCCPTRKDFTGEKIFQEDTIPRIQAVFSFFLSVFVGWYLLEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGAP

SEQ ID NO: 801002 - protein, 416 aa, Homo sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGRYHPTNTDRKKENKPVFFQQI

SEQ ID NO: 801003 - protein, 416 aa, Homo sapiens; identical to SEQ ID NO: 801002

SEQ ID NO: 801004 - protein, 422 aa, Homo sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQGRYHPTNTDRKKENKPVFFQQI

SEQ ID NO: 801005 - protein, 416 aa, Homo sapiens; identical to SEQ ID NO: 801002

SEQ ID NO: 801006 - protein, 416 aa, Homo sapiens; identical to SEQ ID NO: 801002

SEQ ID NO: 801007 - protein, 213 aa, Homo sapiens
SSCCPTRKDFTGEKIFQEDTIPRIQAVFSFFLSVFVGWYLLEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVRLTPIHNSAHLVSEAK

SEQ ID NO: 801008 - protein, 416 aa, Homo sapiens; identical to SEQ ID NO: 801002

SEQ ID NO: 801009 - protein, 416 aa, Homo sapiens; identical to SEQ ID NO: 801002

SEQ ID NO: 801010 - protein, 580 aa, Homo sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFKEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 801011 - protein, 416 aa, Homo sapiens; identical to SEQ ID NO: 801002

SEQ ID NO: 801012 - protein, 383 aa, Homo sapiens
MSRPGVNRPRGRVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGRYHPTNTDRKKENKPVFFQQI

SEQ ID NO: 801013 - protein, 659 aa, Homo sapiens
RPVSNGSAAMASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801014 - protein, 244 aa, Homo sapiens
FTRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 801015 - protein, 299 aa, Homo sapiens [sequence omitted]

SEQ ID NO: 801016 - protein, 134 aa, Homo sapiens
MPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPHDTYELRPCIEKYASIDSY

SEQ ID NO: 801017 - protein, 519 aa, Homo sapiens
MTCCSCTSLSALLDFWAEVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801018 - protein, 446 aa, Homo sapiens [sequence omitted]

SEQ ID NO: 801019 - protein, 360 aa, Homo sapiens
MPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801020 - protein, 291 aa, Homo sapiens
MFGEGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801021 - protein, 360 aa, Homo sapiens; identical to SEQ ID NO: 801019

SEQ ID NO: 801022 - protein, 578 aa, Homo sapiens
RPVSNGSAAMASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGCDGAKSSLRTTTRKISGK

SEQ ID NO: 801023 - protein, 291 aa, Homo sapiens; identical to SEQ ID NO: 801020

SEQ ID NO: 801024 - protein, 268 aa, Homo sapiens [sequence omitted]

SEQ ID NO: 801025 - protein, 659 aa, Homo sapiens; identical to SEQ ID NO: 801013

SEQ ID NO: 801026 - protein, 149 aa, Homo sapiens
MKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801027 - protein, 85 aa, Homo sapiens
SGTSNVVNYVQQIVAPKGSERLVCMAPASPRRLLHPPPPSSTAMLSTMSSRSWHPRAVRGSCAWPLPLQALQAFRIIVCSQIPVP

SEQ ID NO: 801028 - protein, 382 aa, Homo sapiens
RPVSNGSAAMASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFANPANQRQVT

SEQ ID NO: 801029 - protein, 330 aa, Homo sapiens
RPVSNGSAAMASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRCGITLTLVSPVKLSHWLPFFLFVWLFHLLPPRAKFP

SEQ ID NO: 801030 - protein, 667 aa, Homo sapiens
RPVSNGSAAMASGEHSPGSGAARRPLHSAQLRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801031 - protein, 299 aa, Homo sapiens [sequence omitted]

SEQ ID NO: 801032 - protein, 659 aa, Homo sapiens; identical to SEQ ID NO: 801013

SEQ ID NO: 801033 - protein, 557 aa, Homo sapiens
RPVSNGSAAMASGEHSPGSGAARRPLHSAQAVDVASASNFRAFELLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801034 - protein, 360 aa, Homo sapiens; identical to SEQ ID NO: 801019

SEQ ID NO: 801035 - protein, 360 aa, Homo sapiens; identical to SEQ ID NO: 801019

SEQ ID NO: 801036 - protein, 360 aa, Homo sapiens; identical to SEQ ID NO: 801019

SEQ ID NO: 801037 - protein, 659 aa, Homo sapiens; identical to SEQ ID NO: 801013

SEQ ID NO: 801038 - protein, 303 aa, Homo sapiens
MVRGWVLQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801039 - protein, 287 aa, Homo sapiens
GKLNSDLFHRYSLTVELEKNVTGDRLQKLKSCLLSPLPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 801040 - protein, 530 aa, Homo sapiens
RPVSNGSAAMASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPRHAFRGGGTRRERGVTEEAADEHEFIDSASPSWYD

SEQ ID NO: 801041 - protein, 417 aa, Homo sapiens
RPVSNGSAAMASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGPGGSSV

SEQ ID NO: 801042 - protein, 760 aa, Homo sapiens [sequence omitted]

SEQ ID NO: 801043 - protein, 668 aa, Homo sapiens
MPSTLGTSPAKPNSTPVGPSSSKLPLSGLAESVGMTRNGDLGAMKHSPGLSRDLMYFSGATGENGIEQSWFPAVGHERQEEARKFDIPSMESTLNQSAMMETLYSDPHHRVRFHNPRTSTSKELYRVLPEAKKAPGSGAVFERNGPHSNSSGVLPLGLQPAPGLSKPLPSQVWQPSPDTWHPREQSCELSTCRQQLELIRLQMEQMQLQNGAICHHPAAFGPSLPILEPAQWISILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVKGRDKHINNLKKKCQKESEQNREKQQRIETLERYLADLPTLEDHQKQSQQLKDSELKSTELQEKVTELESLLEETQAICREKEIQLESLRQREAEFSSAGHSLQDKQSVEETSGEGPEVEMESWQKRYDSLQKIVEKQQQKMDQLRSQVQSLEQEVAQEEGTSQALREEAQRRDSALQQLRTAVKELSVQNQDLIEKNLTLQEHLRQAQPGSPPSPDTAQLALELHQELASCLQDLQAVCSIVTQRAQGHDPNLSLLLGIHSAQHPETQLDLQKPDVIKRKLEEVQQLRRDIEDLRTTMSDRYAQDMGENCVTQ

SEQ ID NO: 801044 - protein, 194 aa, Homo sapiens
MESWQKRYDSLQKIVEKQQQKMDQLRSQVQSLEQEVAQEEGTSQALREEAQRRDSALQQLRTAVKELSVQNQDLIEKNLTLQEHLRQAQPGSPPSPDTAQLALELHQELASCLQDLQAVCSIVTQRAQGHDPNLSLLLGIHSAQHPETQLDLQKPDVIKRKLEEVQQLRRDIEDLRTTMSDRYAQDMGENCVTQ

SEQ ID NO: 801045 - protein, 614 aa, Homo sapiens
MQEKYPTEGISHVTSPSSDVIQKGSSLGTEWQTPVISEPFRSRFSRCSSVADSGDTAIGTSCSDIAEDFCSSSGSPPFQPIKSHVTIPTAHVMPSTLGTSPAKPNSTPVGPSSSKLPLSGLAESVGMTRNGDLGAMKHSPGLSRDLMYFSGATGENGIEQSWFPAVGHERQEEARKFDIPSMESTLNQSAMMETLYSDPHHRVRFHNPRTSTSKELYRVLPEAKKAPGSGAVFERNGPHSNSSGVLPLGLQPAPGLSKPLPSQVWQPSPDTWHPREQSCELSTCRQQLELIRLQMEQMQLQNGAICHHPAAFGPSLPILEPAQWISILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVKGRDKHINNLKKKCQKESEQNREKQQRIETLERYLADLPTLEDHQKQSQQLKDSELKSTELQEKVTELESLLEETQAICREKEIQLESLRQREAEFSSAGHSLQDKQSVEETSGEGPEVEMESWQKRYDSLQKIVEKQQQKMDQLRSQVQSLALVAQAGVQWRNLGSL

SEQ ID NO: 801046 - protein, 68 aa, Homo sapiens
SLEQEVAQEEGTSQALREEAQRRDSALQQLRTAVKEVSNISQTSWFCLHKPDFFVCPPHLYPNKSPSV

SEQ ID NO: 801047 - protein, 760 aa, Homo sapiens [sequence omitted]

SEQ ID NO: 801048 - protein, 760 aa, Homo sapiens [sequence omitted]

SEQ ID NO: 801049 - protein, 447 aa, Homo sapiens
MQEKYPTEGISHVTSPSSDVIQKGSSLGTEWQTPVISEPFRSRFSRCSSVADSGDTAIGTSCSDIAEDFCSSSGSPPFQPIKSHVTIPTAHVMPSTLGTSPAKPNSTPVGPSSSKLPLSGLAESVGMTRNGDLGAMKHSPGLSRDLMYFSGATGENGIEQSWFPAVGHERQEEARKFDIPSMESTLNQSAMMETLYSDPHHRVRFHNPRTSTSKELYRVLPEAKKAPGSGAVFERNGPHSNSSGVLPLGLQPAPGLSKPLPSQVWQPSPDTWHPREQSCELSTCRQQLELIRLQMEQMQLQNGAICHHPAAFGPSLPILEPAQWISILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVS

SEQ ID NO: 801050 - protein, 203 aa, Homo sapiens
MARPRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 801051 - protein, 203 aa, Homo sapiens; identical to SEQ ID NO: 801050

SEQ ID NO: 801052 - protein, 203 aa, Homo sapiens; identical to SEQ ID NO: 801050

SEQ ID NO: 801053 - protein, 203 aa, Homo sapiens; identical to SEQ ID NO: 801050

SEQ ID NO: 801054 - protein, 190 aa, Homo sapiens
MARPRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGLIPR

SEQ ID NO: 801055 - protein, 245 aa, Homo sapiens
RRLRQGVGGGRSRPGKSRPGSGGAASRHLRGDQGLPGRGAAGMARPRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 801056 - protein, 212 aa, Homo sapiens
MAITRGRGPCTRTRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 801057 - protein, 187 aa, Homo sapiens
MERDSLTYPPLQIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 801058 - protein, 203 aa, Homo sapiens; identical to SEQ ID NO: 801050

SEQ ID NO: 801059 - protein, 316 aa, Homo sapiens
RTRPAGVKPAPYILRSALYVLVFLSLVGATTPPLAVGVGQVTLARSLQSRPVAMSADVTSSLAAFGEGWGVRELSDHSGPRPLLGLARQSPQSGPPSDWGLLPTPPSFWSDAAVRGPCTRTRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGPCTYKAPWGVAEK

SEQ ID NO: 801060 - protein, 203 aa, Homo sapiens; identical to SEQ ID NO: 801050

SEQ ID NO: 801061 - protein, 199 aa, Homo sapiens
MARPRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGPCTYKAPWGVAEK

SEQ ID NO: 801062 - protein, 320 aa, Homo sapiens
RTRPAGVKPAPYILRSALYVLVFLSLVGATTPPLAVGVGQVTLARSLQSRPVAMSADVTSSLAAFGEGWGVRELSDHSGPRPLLGLARQSPQSGPPSDWGLLPTPPSFWSDAAVRGPCTRTRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 801063 - protein, 96 aa, Homo sapiens
RRLRQGVGGGRSRPGKSRPGSGGAASRHLRGDQGLPGRGAAGMARPRPREYKAGDLVFAKMKGYPHWPARIDELPEGAVKPPANKYPIFFFGTHET

SEQ ID NO: 801064 - protein, 42 aa, Homo sapiens
MNGPADGEVDYKKKYRNLKRKLKFLIYVSAAAGRLWGMRPGA

SEQ ID NO: 801065 - protein, 205 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSMAVGPPDCPVGGPLTFPGRGSGAGVGTTLTPLPPPKMPPPTILSTVPRQMFSDAGSGDDALDGDDDLVIDIPE

SEQ ID NO: 801066 - protein, 137 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSERGQA

SEQ ID NO: 801067 - protein, 274 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKSARSGCRAEELDLGEAAGRESSKEAGTAAQMAVGPPDCPVGGPLTFPGRGSGAGVGTTLTPLPPPKMPPPTILSTVPRQMFSDAGSGDDALDGDDDLVIDIPE

SEQ ID NO: 801068 - protein, 270 aa, Homo sapiens
PTRPDPRVRLLGVAGGQTLGATPGPVMNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKMAVGPPDCPVGGPLTFPGRGSGAGVGTTLTPLPPPKMPPPTILSTVPRQMFSDAGSGDDALDGDDDLVIDIPE

SEQ ID NO: 801069 - protein, 195 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKMFSDAGSGDDALDGDDDLVIDIPE

SEQ ID NO: 801070 - protein, 225 aa, Homo sapiens
AHPLPVIQEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKMAVGPPDCPVGGPLTFPGRGSGAGVGTTLTPLPPPKMPPPTILSTVPRQMFSDAGSGDDALDGDDDLVIDIPE

SEQ ID NO: 801071 - protein, 193 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKSARSGCRAEELDLGEAAGRESS

SEQ ID NO: 801072 - protein, 193 aa, Homo sapiens; identical to SEQ ID NO: 801071

SEQ ID NO: 801073 - protein, 123 aa, Homo sapiens
GQALSAAWVGPAVPRASSPSPELPWGAKPSLLRPQCLPDYVPLCFFPLLQMAVGPPDCPVGGPLTFPGRGSGAGVGTTLTPLPPPKMPPPTILSTVPRQMFSDAGSGDDALDGDDDLVIDIPE

SEQ ID NO: 801074 - protein, 244 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKMAVGPPDCPVGGPLTFPGRGSGAGVGTTLTPLPPPKMPPPTILSTVPRQMFSDAGSGDDALDGDDDLVIDIPE

SEQ ID NO: 801075 - protein, 137 aa, Homo sapiens; identical to SEQ ID NO: 801066

SEQ ID NO: 801076 - protein, 244 aa, Homo sapiens; identical to SEQ ID NO: 801074

SEQ ID NO: 801077 - protein, 152 aa, Homo sapiens
MPLHHQITARRRGHPSCLTHRPLRGFPLQASGVPSPYLSSLASSRYPPFPSDYLALQLPEPSPLRPKREKRPRLPRKLKMAVGPPDCPVGGPLTFPGRGSGAGVGTTLTPLPPPKMPPPTILSTVPRQMFSDAGSGDDALDGDDDLVIDIPE

SEQ ID NO: 801078 - protein, 183 aa, Homo sapiens
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSMAVGPPDCPVGGPLTFPGRGSGAGVGTTLTPLPRFKESERDGIRSNPKERR

SEQ ID NO: 801079 - protein, 166 aa, Homo sapiens
MSNQGEQYDRKSIKRSTADSRSMTDTTRSDSYNRQDVEDRQHTAKAEKQHRGKGKEERGGEQAETAAQAEGREDRSGRKGERGKQENRKKGEARRKEQREEDKRARQSKRTKDTRRAKKTGEERKSTRHERQTRTQQQEGENEHGVGRRRRTEERREHGERGPSHE

SEQ ID NO: 801080 - protein, 105 aa, Homo sapiens
ELRYPYICRRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 801081 - protein, 348 aa, Homo sapiens
MALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 801082 - protein, 330 aa, Homo sapiens
MAESVERLQQRVQELERELAQERSLQVPRSGDGGGGRVRIEKMSSEVVDSNPYSRLMALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKVYDNLLECMRDHIE

SEQ ID NO: 801083 - protein, 348 aa, Homo sapiens; identical to SEQ ID NO: 801081

SEQ ID NO: 801084 - protein, 105 aa, Homo sapiens; identical to SEQ ID NO: 801080

SEQ ID NO: 801085 - protein, 404 aa, Homo sapiens
MAESVERLQQRVQELERELAQERSLQVPRSGDGGGGRVRIEKMSSEVVDSNPYSRLMALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 801086 - protein, 293 aa, Homo sapiens
MAESVERLQQRVQELERELAQERSLQVPRSGDGGGGRVRIEKMSSEVVDSNPYSRLMALKRMGIVSDYEKIRTFAVAIVGVGGVGSVTAEMLTRCGIGKLLLFDYDKVELANMNRLFFQPHQAEHHSPCHHIKQTSSRHQADIKQTSSRHQADIKQTSSRHQADIKQTSSRHQADIKQTSSRHQADIKQTSSRHQADIKQTSSRHQADIKQTSSRHQADIKQTSSRHQADIKQTSSRHQADIKQTSSRHQADIKQTSSRHQADIKQASSRHQADIKQTSSRHQADIKQTSSTA

SEQ ID NO: 801087 - protein, 404 aa, Homo sapiens; identical to SEQ ID NO: 801085

SEQ ID NO: 801088 - protein, 404 aa, Homo sapiens; identical to SEQ ID NO: 801085

SEQ ID NO: 801089 - protein, 314 aa, Homo sapiens
MRSNIKPAKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 801090 - protein, 348 aa, Homo sapiens; identical to SEQ ID NO: 801081

SEQ ID NO: 801091 - protein, 404 aa, Homo sapiens; identical to SEQ ID NO: 801085

SEQ ID NO: 801092 - protein, 330 aa, Homo sapiens; identical to SEQ ID NO: 801082

SEQ ID NO: 801093 - protein, 552 aa, Homo sapiens
QIFFRADVEPEAEVPGSGMKGGNADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 801094 - protein, 552 aa, Homo sapiens; identical to SEQ ID NO: 801093

SEQ ID NO: 801095 - protein, 538 aa, Homo sapiens
LYRPFWDGNADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 801096 - protein, 543 aa, Homo sapiens
MAVNSSGYSRWCCFADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 801097 - protein, 543 aa, Homo sapiens; identical to SEQ ID NO: 801096

SEQ ID NO: 801098 - protein, 559 aa, Homo sapiens
QIFFRADVEPEAEVPGSGMKGGNAGEKARQADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 801099 - protein, 518 aa, Homo sapiens
MESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 801100 - protein, 534 aa, Homo sapiens
QIFFRADVEPEAEVPGSGMKGGNADSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGHVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 801101 - protein, 567 aa, Homo sapiens
MGLPVPRPGGGWTQVLGRSHRESFERAGKCGGSSSEESKYSWQREKLASMESPEEPGASMDENYFVNYTFKDRSHSGRVAQGIMKLCLEEELFADVTISVEGREFQLHRLVLSAQSCFFRSMFTSNLKEAHNRVIVLQDVSESVFQLLVDYIYHGTVKLRAEELQEIYEVSDMYQLTSLFEECSRFLARTVQVGNCLQVMWLADRHSDPELYTAAKHCAKTHLAQLQNTEEFLHLPHRLLTDIISDGVPCSQNPTEAIEAWINFNKEEREAFAESLRTSLKEIGENVHIYLIGKESSRTHSLAVSLHCAEDDSISVSGQNSLCHQITAACKHGGDLYVVGGSIPRRMWKCNNATVDWEWCAPLPRDRLQHTLVSVPGKDAIYSLGGKTLQDTLSNAVIYYRVGDNVWTETTQLEVAVSGAAGANLNGIIYLLGGEENDLDFFTKPSRLIQCFDTETDKCHVKPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 801102 - protein, 518 aa, Homo sapiens; identical to SEQ ID NO: 801099

SEQ ID NO: 801103 - protein, 121 aa, Homo sapiens
LLKPFGTSPLFRKTLQPYVLPFAGRMHAAVHKDLVFIVAEGDSLVCYNPLLDSFTRLCLPEAWSSAPSLWKIASCNGSIYVFRDRYKKGDANTYKLDPATSAVTVTRGIKVLLTNLQFVLA

SEQ ID NO: 801104 - protein, 325 aa, Homo sapiens
TVATALLRTRGQPSSPSPLAYMLSLYRDPLPRADIIRSLQAEDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 801105 - protein, 391 aa, Homo sapiens
MYSMMMETDLHSPGGAQAPTNLSGPAGAGGGGGGGGGGGGGGGAKANQDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLAAGAGGGGAAVAMGVGVGVGAAAVGQRLESPGGAAGGGYAHVNGWANGAYPGSVAAAAAAAAMMQEAQLAYGQHPGAGGAHPHAHPAHPHPHHPHAHPHNPQPMHRYDMGALQYSPISNSQGYMSASPSGYGGLPYGAAAAAAAAAGGAHQNSAVAAAAAAAAASSGALGALGSLVKSEPSGSPPAPAHSRAPCPGDLREMISMYLPAGEGGDPAAAAAAAAQSRLHSLPQHYQGAGAGVNGTVPLTHI

SEQ ID NO: 801106 - protein, 387 aa, Homo sapiens
PAHSARMYNMMETELKPPGPQQTSGGGGGNSTAAAAGGNQKNSPDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLAAGAGGGGAAVAMGVGVGVGAAAVGQRLESPGGAAGGGYAHVNGWANGAYPGSVAAAAAAAAMMQEAQLAYGQHPGAGGAHPHAHPAHPHPHHPHAHPHNPQPMHRYDMGALQYSPISNSQGYMSASPSGYGGLPYGAAAAAAAAAGGAHQNSAVAAAAAAAAASSGALGALGSLVKSEPSGSPPAPAHSRAPCPGDLREMISMYLPAGEGGDPAAAAAAAAQSRLHSLPQHYQGAGAGVNGTVPLTHI

SEQ ID NO: 801107 - protein, 413 aa, Homo sapiens
MHLALTTVLLWAWGLQAFEIVEKENIFQRTPCPAFLMFENAAYLADMSFELPCHCKPEEVPAVVWFYQKHLGSSHTKVLTDFDGRVLTEAAQVRVGSDMLTRFSIRMFSLLVFRAQSEDSGLYFCGTRKGDYFYAYDVDIQNSEGMVATFQDKGQEPFADEYYGHLHVFTTFWEWTPCDRCGVRGEQWRIGLCYLQSPDLSPRYLKAVPDVVSCGSRAVPRKLRTKARDHTPEVLVRSCLVPCEKTKTIREGVLAIINYVSKVGSRPWVPQVPIQFHQQRLGHGLIISCPGARPEHAVAWDKDRQHLYRTQYLKGVNRSMRVFIDHGNQLHIRFTQLDDRGIYYCWRQGVLVAGFRLGVTSHGHYPASFSDPETRSAVELTLIGYLLITAVFVTIHFCRCCCYLFHCCPSFSP

SEQ ID NO: 801108 - protein, 413 aa, Homo sapiens; identical to SEQ ID NO: 801107

SEQ ID NO: 801109 - protein, 413 aa, Homo sapiens; identical to SEQ ID NO: 801107

SEQ ID NO: 801110 - protein, 242 aa, Homo sapiens
MERNDIINFKALEKELQAALTADEKYKRENAAKLRAVEQRVASYEEFRGIVLASHLKPLERKDKMGGKRTVPWNCHTIQGRTFQDVATEISPEKAPLQPETSADFYRDWRRHLPSGPERYQALLQLGGPRLGCLFQTDVGFGLLGELLVALADHVGPADRAAVLGILCSLASTGRFTLNLSLLSRAERESCKGLFQKLQAMGNPRSVKEGLSWEEQGLEEQSGGLQEEERLLQELLELYQVD

SEQ ID NO: 801111 - protein, 413 aa, Homo sapiens; identical to SEQ ID NO: 801107

SEQ ID NO: 801112 - protein, 242 aa, Homo sapiens; identical to SEQ ID NO: 801110

SEQ ID NO: 801113 - protein, 413 aa, Homo sapiens; identical to SEQ ID NO: 801107

SEQ ID NO: 801114 - protein, 351 aa, Homo sapiens
ERAVRAHGAGWDRGGYRGRGAMRRPSVRAAGLVLCTLCYLLVGAAVFDALESEAESGRQRLLVQKRGALRRKFGFSAEDYRELERLALQAEPHRAGRQWKFPGSFYFAITVITTIGYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARPPSPRPPGAPESRGLWLPRRPARSVGSASVFCHVHKLERCARDNLGFSPPSSPGVVRGGQAPRPGARWKSI

SEQ ID NO: 801115 - protein, 455 aa, Homo sapiens
ERAVRAHGAGWDRGGYRGRGAMRRPSVRAAGLVLCTLCYLLVGAAVFDALESEAESGRQRLLVQKRGALRRKFGFSAEDYRELERLALQAEPHRAGRQWKFPGSFYFAITVITTIDEHLPRNCSHGQDWNIAINPQNSTMPSVVKPAPNPSYWQATTDLFSVATVFVISRVSFIGNHAVCRLSSSSSSTQLRHLRSILGCRKLQEFIQLLKKIGVWMPPGYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARPPSPRPPGAPESRGLWLPRRPARSVGSASVFCHVHKLERCARDNLGFSPPSSPGVVRGGQAPRPGARWKSI

SEQ ID NO: 801116 - protein, 121 aa, Homo sapiens
GRQRLLVQKRGALRRKFGFSAEDYRELERLALQAEPHRAGRQWKFPGSFYFAITVITTIGEPPGASLRARSSPSRPGAPLGFGPTSAPAQLSYFGRVISAHRASLISFASLVSLVSFAPLC

SEQ ID NO: 801117 - protein, 309 aa, Homo sapiens
DSSAHQQVTQGAQDQPGRAHARPPHGAPAPVPAAVPTCSVCPDRALQAEPHRAGRQWKFPGSFYFAITVITTIGYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARPPSPRPPGAPESRGLWLPRRPARSVGSASVFCHVHKLERCARDNLGFSPPSSPGVVRGGQAPRPGARWKSI

SEQ ID NO: 801118 - protein, 473 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801119 - protein, 117 aa, Homo sapiens
MSEEGKQRHRPCPPSLQRPNCSLPLGSGRVTQLATVPLTCSAAPPSTTTSSKESPFPQQRTRPRREGCWEVWSKRGLGPARSPRSPSCSCRIGLNLKNPGLIMVAGTFPLGSVICPH

SEQ ID NO: 801120 - protein, 311 aa, Homo sapiens
MKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801121 - protein, 430 aa, Homo sapiens
MSTELFSSTREEGSSGSGPSFRSNQRKMLNLLLERDTSFTVCPDVPRTPVGKFLGDSANLSILSGSPGFFRTSGSAFSWDAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801122 - protein, 439 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801123 - protein, 246 aa, Homo sapiens
GPLMICGHTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801124 - protein, 117 aa, Homo sapiens
MGTNREALYSKAQSLKLIRLTGNEENLKEKQDAWTRITPFTDSLYLIAGHLDSSGLQEVHLAGMNHDQHLMKCSPVSSLSFFGFCFAFQVGGRGFPLHLWLEDAGRSQQTFKENVSV

SEQ ID NO: 801125 - protein, 400 aa, Homo sapiens
MSTELFSSTREEGSSGSGPSFRSNQRKMLNLLLERDTSFTVCPDVPRTPVGKFLGDSANLSILSGSPGFFRTSGSAFSWDDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801126 - protein, 443 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801127 - protein, 490 aa, Homo sapiens
MSEEARFCFSPGENSKTMSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801128 - protein, 461 aa, Homo sapiens
MGTNREALYSKAQSLKLIRLTGNEENLKEKQDAWTRITPFTDSLYLIAGHLDSSGLQEVHLAGMNHDQHLMKCSPVSSLSFFGFCFAFQVGGRGFPLHLWLEDAGRSQQTPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 801129 - protein, 461 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVSRFLEMVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMVKGGACGEPNFNNSTPRACKAFREETAAPP

SEQ ID NO: 801130 - protein, 162 aa, Homo sapiens
MNSRTASARGWFSSRPPTSESDLEPATDGPASETTTLSPEATTFNDTRIPDAAGGTAGVGTMLLSFGIITVIGLAVALVLYIRKKKRLEKLRHQLMPMYNFDPTEEQDELEQELLEHGRDAASVQAATSVQAMQGKTTLPSQGPLQRPSRLVFTDVANAIHV

SEQ ID NO: 801131 - protein, 162 aa, Homo sapiens; identical to SEQ ID NO: 801130

SEQ ID NO: 801132 - protein, 230 aa, Homo sapiens
GRGACREARRCSFGDPPRLLGPAPPPPWVPALPTLAQAGRASARGCGWCAVAGLASGSGLAGRADLGSDPQPQTPGLGVPPAPASCQSLPPLASPTELGAGRGLSFVHQEEEEGNLKALSMVVCCGSASQEAGPGGLLGGEGPALSPAAFAPIPRLEKLRHQLMPMYNFDPTEEQDELEQELLEHGRDAASVQAATSVQAMQGKTTLPSQGPLQRPSRLVFTDVANAIHV

SEQ ID NO: 801133 - protein, 160 aa, Homo sapiens
GRGACREARRCSFGDPPRLLGPAPPPPWVPALPTLAQAGRASARGCGWCAVAGLASGSGLAGRADLGSDPQPQTPGLGVPPAPASCQSLPPLASPTELGAGRGLNYSALPGPTAETQPAGVYRCGQCHPCVSGLGQAWTSDRDPSRCLQSSPLPDCQDLL

SEQ ID NO: 801134 - protein, 153 aa, Homo sapiens
MQGCQEKGNSHPGSIHTTEGPGGLPATHPWQPDVTGAKLGWELRGKEVGEWKWKDAAPPDLPRGLMHVHECAHGQTCACPSTAGRMRLSTLAPPSKSTSTPWYVVEHQGRLSSLPSIFRDCREEGSTHSTVPLSTALFHWAHLLLKTAPCLGL

SEQ ID NO: 801135 - protein, 162 aa, Homo sapiens; identical to SEQ ID NO: 801130

SEQ ID NO: 801136 - protein, 153 aa, Homo sapiens; identical to SEQ ID NO: 801134

SEQ ID NO: 801137 - protein, 162 aa, Homo sapiens; identical to SEQ ID NO: 801130

SEQ ID NO: 801138 - protein, 162 aa, Homo sapiens; identical to SEQ ID NO: 801130

SEQ ID NO: 801139 - protein, 134 aa, Homo sapiens
GRELAPITADLPRPPCWEETTRHAAAERLQTRKRRRRRRRRRSLPRAAAAPGGWGRRAAREERPEPQRYGGPAGPPAFACRAAWGVAGLWWHRAQHFGLLVAAELRDQRSPHSAPLLLPSEQDSWLLCTGFLTF

SEQ ID NO: 801140 - protein, 153 aa, Homo sapiens
VGTGRLSWKKRLSVQTCSTATSSSTATLTADQKLTRSKLPSCRLRSRASKARSSVSIWMLRSSRVRMVSMDSYRAAGGEGSGLPPPIREQRPKKPGDTEGGCINPGRYSCKHRLVQAKFKSSPCHSLAVTMSNLINLSEPVSSSISFQIAVNI

SEQ ID NO: 801141 - protein, 136 aa, Homo sapiens
MAGPAEDDPEQQQQEAHETVADDGDEGPLGDGCPHDRQHPQTSTDSGAASMDSSQPDQETSRGASLHRGNFVEALAGMCRLCASRAVCLYVGLPLWVRPVIVTYSDPAVFSSRSTCSPWRITSLKLYHEDSQCSQV

SEQ ID NO: 801142 - protein, 196 aa, Homo sapiens
MLKDDRLGQHVPTLHPNGVLLCRPGWSAVVQSRLTASSASRVHAILLPQPPEWLGLQASEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYID

SEQ ID NO: 801143 - protein, 198 aa, Homo sapiens
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYID

SEQ ID NO: 801144 - protein, 198 aa, Homo sapiens; identical to SEQ ID NO: 801143

SEQ ID NO: 801145 - protein, 198 aa, Homo sapiens; identical to SEQ ID NO: 801143

SEQ ID NO: 801146 - protein, 198 aa, Homo sapiens; identical to SEQ ID NO: 801143

SEQ ID NO: 801147 - protein, 156 aa, Homo sapiens
NPTISNTVSIAGPDMYNEHDPYLCMLKTSMICDIDATVSASSIGNRYGVRGSMLLQTQNRDVCEDVKRVQVYLESLMTDETIANVPILILGNKIDRPEAISEERLREMFGLYGQTTGKGSISLKELNARPLEVFMCSVLKRQGYGEGFRWMAQYID

SEQ ID NO: 801148 - protein, 203 aa, Homo sapiens
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLQTHIGSRSQRSGLLRDLIAQHA

SEQ ID NO: 801149 - protein, 198 aa, Homo sapiens; identical to SEQ ID NO: 801143

SEQ ID NO: 801150 - protein, 198 aa, Homo sapiens; identical to SEQ ID NO: 801143

SEQ ID NO: 801151 - protein, 155 aa, Homo sapiens
MLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYID

SEQ ID NO: 801152 - protein, 185 aa, Homo sapiens
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDLILGNKIDRPEAISEERLREMFGLYGQTTGKGSISLKELNARPLEVFMCSVLKRQGYGEGFRWMAQYID

SEQ ID NO: 801153 - protein, 981 aa, Homo sapiens
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKRRIDYILVYRKTNIPYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 801154 - protein, 495 aa, Homo sapiens
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKRRIDYILVYRKTNIPYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWGKYFLHYFLSLIF

SEQ ID NO: 801155 - protein, 492 aa, Homo sapiens
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKRRIDYILVYRKTNIPYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWGNAVNIGILI

SEQ ID NO: 801156 - protein, 1507 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 801157 - protein, 1507 aa, Homo sapiens; identical to SEQ ID NO: 801156

SEQ ID NO: 801158 - protein, 1507 aa, Homo sapiens; identical to SEQ ID NO: 801156

SEQ ID NO: 801159 - protein, 1507 aa, Homo sapiens; identical to SEQ ID NO: 801156

SEQ ID NO: 801160 - protein, 958 aa, Homo sapiens
ADRVTTTPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 801161 - protein, 1507 aa, Homo sapiens; identical to SEQ ID NO: 801156

SEQ ID NO: 801162 - protein, 1500 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 801163 - protein, 1489 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 801164 - protein, 1420 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQLTALTTLIWKMTSSYL

SEQ ID NO: 801165 - protein, 1507 aa, Homo sapiens; identical to SEQ ID NO: 801156

SEQ ID NO: 801166 - protein, 111 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNAVGLLLTFLQRLSSVDAVSLLFFRE

SEQ ID NO: 801167 - protein, 1148 aa, Homo sapiens
LYMIPCLHVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 801168 - protein, 1507 aa, Homo sapiens; identical to SEQ ID NO: 801156

SEQ ID NO: 801169 - protein, 1148 aa, Homo sapiens; identical to SEQ ID NO: 801167

SEQ ID NO: 801170 - protein, 1507 aa, Homo sapiens; identical to SEQ ID NO: 801156

SEQ ID NO: 801171 - protein, 1491 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHILPTTTRGTVPPLILQMILSSNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 801172 - protein, 1507 aa, Homo sapiens; identical to SEQ ID NO: 801156

SEQ ID NO: 801173 - protein, 1507 aa, Homo sapiens; identical to SEQ ID NO: 801156

SEQ ID NO: 801174 - protein, 1180 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKYVSAFGT

SEQ ID NO: 801175 - protein, 415 aa, Homo sapiens
PAGGARRKGTAAGPAEAAERTAHQGSGSSDRVKLRWLPGSPAGMHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGLVTEGSGLQPGLLDVLLKPPSKKSESLRPPHCKDT

SEQ ID NO: 801176 - protein, 695 aa, Homo sapiens
PAGGARRKGTAAGPAEAAERTAHQGSGSSDRVKLRWLPGSPAGMHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKDAAEARREFQRDAGGPAVLGDPAHPPQLLARVLSPSLPGAGGAGGLVPLPGAPGGRPSPPNPELRLEAPGASEPLHHHPYKYPAAAYDHYLGAKSRPAPYPLPGLRGHGYHPHAHPHHHHHPVSPAAAAAAAAAAAAAAANMYSSAGAAPPAPTTIAPDNTGPVALPPRSCTAPKFAGPGHPAPRASKEYVPPAPGATAALPFPSLEAMGAPSPPPAPWAIEVSGSPVPGATAGPSPAPRAKGVPARQCQSARSEAEGSDIYCSPRDRVARGPAGSCSVDSPRAPPAGGVDTCRYCRYCRYRPGADLINGFASFGK

SEQ ID NO: 801177 - protein, 441 aa, Homo sapiens
PAGGARRKGTAAGPAEAAERTAHQGSGSSDRVKLRWLPGSPAGMHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGGHVLKDKEVKAETSRNTPEREVELLRDAGGCVNLGLPCPAECQPFNTQGLVAGRTAGDRLC

SEQ ID NO: 801178 - protein, 214 aa, Homo sapiens
PAGGARRKGTAAGPAEAAERTAHQGSGSSDRVKLRWLPGSPAGMHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYR

SEQ ID NO: 801179 - protein, 436 aa, Homo sapiens
PAGGARRKGTAAGPAEAAERTAHQGSGSSDRVKLRWLPGSPAGMHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGRAGVVGSGFRPCARSTPGRRPRPTSPAPPGRSRLSRRLHNGRGGGQARTRPPGPTA

SEQ ID NO: 801180 - protein, 214 aa, Homo sapiens; identical to SEQ ID NO: 801178

SEQ ID NO: 801181 - protein, 120 aa, Homo sapiens
EDTQKSPSIRNRLPPDTESAGALILNFPTSRTVATRLSLLVSSQDHRTHRIPRQPIPSWMSSKCLKVLLYQVSQTSSLRTIHSRAQLFYWRSEGKAITRTTLVTGWTGSQLLGMTSGNPE

SEQ ID NO: 801182 - protein, 114 aa, Homo sapiens
GRFPPRTRARRRQQRPPADAENPKPCRMAKLQHGSHPDHHVKEISPTRNKHLPCNIRSFLGLGACAYLLPESWSILRCLPPAPVHSQEPRSQRQAWKTYSSPSEGCCGFPCCGD

SEQ ID NO: 801183 - protein, 94 aa, Homo sapiens
GRFPPRTRARRRQQRPPADAENPKPCRMAKLQHGSHPDHHVKEISPTRNKHLPCNIRCLPPAPVHSQEPRSQRQAWKTYSSPSEGCCGFPCCGD

SEQ ID NO: 801184 - protein, 84 aa, Homo sapiens
GRFPPRTRARRRQQRPPADAENPKPCRMAKLQHGSHPDHHVKEISPTRNKHLPCNIRWPPDFLCLYPPRTTELIASQGSLFHHG

SEQ ID NO: 801185 - protein, 94 aa, Homo sapiens; identical to SEQ ID NO: 801183

SEQ ID NO: 801186 - protein, 126 aa, Homo sapiens
MCFPKIEVISSLSDDSDPELDYTSLPVLENLPTDTLSNIFAVSKDTSKAARVPFTDIFKKEAKRDLEIRKQDTKSPRPLIQELSDEDPSGQLLMPPTCQRDAAPLTSSGDRDSDFLAASSPAAKCI

SEQ ID NO: 801187 - protein, 158 aa, Homo sapiens [sequence omitted]

SEQ ID NO: 801188 - protein, 189 aa, Homo sapiens
MCFPKIEVISSLSDDSDPELDYTSLPVLENLPTDTLSNIFAVSKDTSKAARVPFTDIFKKEAKRDLEIRKQDTKSPRPLIQELSDEDPSGQLLMPPTCQRDAAPLTSSGDRDSDFLAASSPEMGFHHVDQAGLELLTSGDLFASASQSAGITVPTESAATPPETCVGVAQPSQALPTWDLTAFPAPKAS

SEQ ID NO: 801189 - protein, 363 aa, Homo sapiens
KTAPLCRLQQIGAMALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPYNIVKFCRAIDIIYSLITSCNMSKRMDIAIQVTESIALFHSCLNPILYVFMGASFKNYVMKVAKKYGSWRRQRQSVEEFPFDSEGPTEPTSTFSI

SEQ ID NO: 801190 - protein, 363 aa, Homo sapiens; identical to SEQ ID NO: 801189

SEQ ID NO: 801191 - protein, 363 aa, Homo sapiens; identical to SEQ ID NO: 801189

SEQ ID NO: 801192 - protein, 154 aa, Homo sapiens
AGSGELAVVHEWREDGLRLWVFGLSVPKEAAELGDAAHGAPARVGELLLLALHHSHVFAPMITDAVDGDAREDGPHDESQDDCNGQEGDGNQLVVAFEGPPPFNCDITVGCCGNDCPVTKDCDLSRSSKYLLRNKDSVIQQIPLVIKGSQGNSP

SEQ ID NO: 801193 - protein, 154 aa, Homo sapiens; identical to SEQ ID NO: 801192

SEQ ID NO: 801194 - protein, 154 aa, Homo sapiens; identical to SEQ ID NO: 801192

SEQ ID NO: 801195 - protein, 1951 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 801196 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 801197 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 801198 - protein, 944 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEW

SEQ ID NO: 801199 - protein, 163 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVP

SEQ ID NO: 801200 - protein, 264 aa, Homo sapiens
KREEKSARSRLGVNRPRRVTLLWQAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVD

SEQ ID NO: 801201 - protein, 875 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801202 - protein, 875 aa, Homo sapiens; identical to SEQ ID NO: 801201

SEQ ID NO: 801203 - protein, 704 aa, Homo sapiens [sequence omitted]

SEQ ID NO: 801204 - protein, 869 aa, Homo sapiens
RTEESRLGPHGIIFHGLLSKFLCSWPLEPLHHIPQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801205 - protein, 602 aa, Homo sapiens
MENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801206 - protein, 473 aa, Homo sapiens
MLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801207 - protein, 473 aa, Homo sapiens; identical to SEQ ID NO: 801206

SEQ ID NO: 801208 - protein, 875 aa, Homo sapiens; identical to SEQ ID NO: 801201

SEQ ID NO: 801209 - protein, 106 aa, Homo sapiens
GFAVDKMAGEVKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801210 - protein, 637 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQEDDRLSRKSQTEVHGGWAGANRWGEQWPQSRHGPTYYNNSQYIGREDRQQTGPQLKTHTTMRTPARRMTSGETLHQTWSKPRNIHGGRNDQQTYKRTDVRELSTPGNRKEQGIHGPMPRDYTSEQTPGPTPASTTHPPLAPPWRGMRTHGTSTRLMEHRPLPTENYDDC

SEQ ID NO: 801211 - protein, 434 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATGNL

SEQ ID NO: 801212 - protein, 297 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRYVNDVLPCLIFSNH

SEQ ID NO: 801213 - protein, 108 aa, Homo sapiens
MNTWTKQMGFPLIYVEAEQVEDDRLLRLSQKKFCAGGSYVGEDCPQWMVPITISTSEDPNQAKLKILMDKPEMNVVLKNVKPDQWVKVSSESYLNRFLSLIHFMAGFK

SEQ ID NO: 801214 - protein, 875 aa, Homo sapiens; identical to SEQ ID NO: 801201

SEQ ID NO: 801215 - protein, 925 aa, Homo sapiens
SGRKSQGWDLMASFSMDCSPSFCVPGLWNPFIIFRSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801216 - protein, 669 aa, Homo sapiens
KREEKSARSRLGVNRPRRVTLLWQAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801217 - protein, 599 aa, Homo sapiens
LFSFHINEGKSICLVQVFITAAIGLPLAFSKLSQRSSVAAFFCWNEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801218 - protein, 473 aa, Homo sapiens; identical to SEQ ID NO: 801206

SEQ ID NO: 801219 - protein, 231 aa, Homo sapiens
SLMSLLLLKSGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 801220 - protein, 875 aa, Homo sapiens; identical to SEQ ID NO: 801201

SEQ ID NO: 801221 - protein, 875 aa, Homo sapiens; identical to SEQ ID NO: 801201

SEQ ID NO: 801222 - protein, 388 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHQSVETHM

SEQ ID NO: 801223 - protein, 1016 aa, Homo sapiens [sequence omitted]

SEQ ID NO: 801224 - protein, 1026 aa, Homo sapiens
MSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRAKALAGQSVRICKGPRAVFSRILLLFSLTDSMEDEDAACGGQGQLSTVLLVNLGRMEFPSYTINRKTHIFQDRDDLIRYAAATHMLSDISSAMANGNWEEAKELAQCAKRDWNRLKNHPSLRCHEDLPLFLRCFTVGWIYTRILSRFVEILQRLHMYEEAVRELESLLSQRIYCPDSRGRWWDRLALNLHQHLKRLEPEPDVDHALCQTIKCITEGLADPEVRTGHRLSLYQRAVRLRESPSCKKFKHLFQQLPEMAVQDVKHVTITGRLCPQRGMCKSVFVMEAGEAADPTTVLCSVEELALAHYRRSGFDQGIHGEGSTFSTLYGLLLWDIIFMDGIPDVFRNACQAFPLDLCTDSFFTSRRPALEARLQLIHDAPEESLRAWVAATWHEQEGRVASLVSWDRFTSLQQAQDLVSCLGGPVLSGVCRHLAADFRHCRGGLPDLVVWNSQSRHFKLVEVKGPNDRLSHKQMIWLAELQKLGAEVEVCHVVAVGAKSQSLS

SEQ ID NO: 801225 - protein, 632 aa, Homo sapiens
MPEVLGSQGWLQASSAATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRAKALAGQSVRICKGPRAVFSRILLLFSLTDSMEDEDAACGGQGQLSTVLLVNLGRMEFPSYTINRKTHIFQDRDDLIRYAAATHMLSDISSAMANGNWEEAKELAQCAKRDWNRLKNHPSLRCHEDLPLFLRCFTVGWIYTRILSRFVEILQRLHMYEEAVRELESLLSQRIYCPDSRGRWWDRLALNLHQHLKRLEPEPDVDHALCQTIKCITEGLADPEVRTGHRLSLYQRAVRLRESPSCKKFKHLFQQLPEMAVQDVKHVTITGRLCPQRGMCKSVFVMEAGEAADPTTVLCSVEELALAHYRRSGFDQGIHGEGSTFSTLYGLLLWDIIFMDGIPDVFRNACQAFPLDLCTDSFFTSRRPALEARLQLIHDAPEESLRAWVAATWHEQEGRVASLVSWDRFTSLQQAQDLVSCLGGPVLSGVCRHLAADFRHCRGGLPDLVVWNSQSRHFKLVEVKGPNDRLSHKQMIWLAELQKLGAEVEVCHVVAVGAKSQSLS

SEQ ID NO: 801226 - protein, 532 aa, Homo sapiens
MSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRFCWLLLQ

SEQ ID NO: 801227 - protein, 1026 aa, Homo sapiens
MSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRAKALAGQSVRICKGPRAVFSRILLLFSLTDSMEDEDAACGGQGQLSTVLLVNLGRMEFPSYTINRKTHIFQDRDDLIRYAAATHMLSDISSAMANGNWEEAKELAQCAKRDWNRLKNHPSLRCHEDLPLFLRCFTVGWIYTRILSRFVEILQRLHMYEEAVRELESLLSQRIYCPDSRGRWWDRLALNLHQHLKRLEPELMCDHALCQTIKCITEGLADPEVRTGHRLSLYQRAVRLRESPSCKKFKHLFQQLPEMAVQDVKHVTITGRLCPQRGMCKSVFVMEAGEAADPTTVLCSVEELALAHYRRSGFDQGIHGEGSTFSTLYGLLLWDIIFMDGIPDVFRNACQAFPLDLCTDSFFTSRRPALEARLQLIHDAPEESLRAWVAATWHEQEGRVASLVSWDRFTSLQQAQDLVSCLGGPVLSGVCRHLAADFRHCRGGLPDLVVWNSQSRHFKLVEVKGPNDRLSHKQMIWLAELQKLGAEVEVCHVVAVGAKSQSLS

SEQ ID NO: 801228 - protein, 652 aa, Homo sapiens
YDEAHDGASQEEEIVETNNMRSYRIPLLVISSQESKTTGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRAKALAGQSVRICKGPRAVFSRILLLFSLTDSMEDEDAACGGQGQLSTVLLVNLGRMEFPSYTINRKTHIFQDRDDLIRYAAATHMLSDISSAMANGNWEEAKELAQCAKRDWNRLKNHPSLRCHEDLPLFLRCFTVGWIYTRILSRFVEILQRLHMYEEAVRELESLLSQRIYCPDSRGRWWDRLALNLHQHLKRLEPEPDVDHALCQTIKCITEGLADPEVRTGHRLSLYQRAVRLRESPSCKKFKHLFQQLPEMAVQDVKHVTITGRLCPQRGMCKSVFVMEAGEAADPTTVLCSVEELALAHYRRSGFDQGIHGEGSTFSTLYGLLLWDIIFMDGIPDVFRNACQAFPLDLCTDSFFTSRRPALEARLQLIHDAPEESLRAWVAATWHEQEGRVASLVSWDRFTSLQQAQDLVSCLGGPVLSGVCRHLAADFRHCRGGLPDLVVWNSQSRHFKLVEVKGPNDRLSHKQMIWLAELQKLGAEVEVCHVVAVGAKSQSLS

SEQ ID NO: 801229 - protein, 937 aa, Homo sapiens
MSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRAKALAGQSVRICKGPRAVFSRILLLFSLTDSMEDEDAACGGQGQLSTVLLVNLGRMEFPSYTINRKTHIFQDRDDLIRYAAATHMLSDISSAMANGNWEEAKELAQCAKRDWNRLKNHPSLRCHEDLPLFLRCFTVGWIYTRILSRFVEILQRLHMYEEAVRELESLLSQRIYCPDSRGRWWDRLALNLHQHLKRLEPEPDVDHALCQTIKCITEGLADPEVRTGHRLSLYQRAVRLRESPSCKKFKHLFQQLPEMAVQDVKHVTITGRLCPQRGMCKSVFVMEAGEAADPTTVLCSVEELALAHYRRSGFDQGIHGEGSTFSTLYGLLLWDIIFMDGIPDVFRNACQAFPLDLCTDSFFTSRRPALEARLQLIHDAPEESLRAWVAATWHEQEGRVASLVIGIQSFELKRE

SEQ ID NO: 801230 - protein, 296 aa, Homo sapiens
MALTSDLGKQIKLKEVEGTLLQPATVDNWSQIQSFEAKPDDLLICTYPKAGTTWIQEIVDMIEQNGDVEKCQRAIIQHRHPFIEWARPPQPSGVEKAKAMPSPRILKTHLSTQLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 801231 - protein, 111 aa, Homo sapiens
GPHVVLVLRRCFLLSYFKGVEKAKAMPSPRILKTHLSTQLLPPSFWENNCKVRYQQLPVTEGKVSQPKRVLQTPTQSIRDHLCLSTVSDAYQQRENIKFYIQQDIHLNSFK

SEQ ID NO: 801232 - protein, 296 aa, Homo sapiens; identical to SEQ ID NO: 801230

SEQ ID NO: 801233 - protein, 291 aa, Homo sapiens
MLGKQIKLKEVEGTLLQPATVDNWSQIQSFEAKPDDLLICTYPKAGTTWIQEIVDMIEQNGDVEKCQRAIIQHRHPFIEWARPPQPSGVEKAKAMPSPRILKTHLSTQLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 801234 - protein, 144 aa, Homo sapiens
MALTSDLGKQIKLKEVEGTLLQPATVDNWSQIQSFEAKPDDLLICTYPKAGTTWIQEIVDMIEQNGDVEKCQRAIIQHRHPFIEWARPPQPSETGFHHVAQAGLKLLSSSNPPASTSQSAKITDVSHCPWSSLHILNIVIYILY

SEQ ID NO: 801235 - protein, 296 aa, Homo sapiens; identical to SEQ ID NO: 801230

SEQ ID NO: 801236 - protein, 307 aa, Homo sapiens
MALTSDLGKQIKLKEVEGTLLQPATVDNWSQIQSFEAKPDDLLICTYPKAGTTWIQEIVDMIEQNGDVEKCQRAIIQHRHPFIEWARPPQPSETGFHHVAQAGLKLLSSSNPPASTSQSAKITDLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 801237 - protein, 296 aa, Homo sapiens; identical to SEQ ID NO: 801230

SEQ ID NO: 801238 - protein, 160 aa, Homo sapiens [sequence omitted]

SEQ ID NO: 801239 - protein, 641 aa, Homo sapiens
MNWAAFGGSEFFIPEGIQIDSRCPLSRNITEWYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQAYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 801240 - protein, 336 aa, Homo sapiens
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYCAVCNDYASGYHYGVWSCEGCKAFFKRSIQGHNDYMCPATNQCTIDKNRRKSCQACRLRKCYEVGMMKGDEEKENNRASKPHSTPATLQWLEENYEIAEGVCIPRSALYMHYLDFCEKNDTQPVNAASFGKIIRQQFPQLTTRRLGTRGQSK

SEQ ID NO: 801241 - protein, 557 aa, Homo sapiens
MNWAAFGGSEFFIPEGIQIDSRCPLSRNITEWYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQAYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQVKKWRL

SEQ ID NO: 801242 - protein, 107 aa, Homo sapiens
CNLKLILTLWNFFPLNKYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 801243 - protein, 563 aa, Homo sapiens
MIKRRAHPGAGGDRTRPRRRRSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGNGKSFKNFG

SEQ ID NO: 801244 - protein, 671 aa, Homo sapiens
SGEKPFRAEASSSARPYGLRAEFSDNHTGKMNWAAFGGSEFFIPEGIQIDSRCPLSRNITEWYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQAYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 801245 - protein, 598 aa, Homo sapiens
MPTKQKYHGMKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQAYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 801246 - protein, 213 aa, Homo sapiens
SDAWVSFNMAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 801247 - protein, 213 aa, Homo sapiens; identical to SEQ ID NO: 801246

SEQ ID NO: 801248 - protein, 183 aa, Homo sapiens
SDAWVSFNMAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWCEAQRCRVQQRCSLCVQAGGQRGSEETQALPVSMAGSPSPLPGSPGAQEGGV

SEQ ID NO: 801249 - protein, 78 aa, Homo sapiens
MAGLMLGPPHLCFSPSRHYQRFTDCYKCFYQLQPAMTQQIYDKFIAQLQTSIREEISDIKEEGNLEAVLRPRVLWSAR

SEQ ID NO: 801250 - protein, 213 aa, Homo sapiens; identical to SEQ ID NO: 801246

SEQ ID NO: 801251 - protein, 177 aa, Homo sapiens
WTRPITLRDQRRMGWDTFLQKLVAAGYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 801252 - protein, 215 aa, Homo sapiens
SDAWVSFNMAEASSANLGSGCEEKRHEGSSSESVPPGTTISRVKLLDTMVDTFLQKLVAAGSSPLLHWDGSAGPRLPSGGQSVKQAFSWAACRLPQGRKEEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 801253 - protein, 208 aa, Homo sapiens
KVRQVACDPIIAPREIFRAQLTGSGGQHTGTTISRVKLLDTMVDTFLQKLVAAGSSPLLHWDGSAGPRLPSGGQSVKQAFSWAACRLPQGRKEEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 801254 - protein, 69 aa, Homo sapiens
SSCSSLCLSCARGTIGATRPGQHELRPAPPGAGGKHMGELQLQVQAQQQAWQALHREQRELVAVLREPE

SEQ ID NO: 801255 - protein, 223 aa, Homo sapiens
SDAWVSFNMAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQREWFPSPFPWPWLGESVFNLH

SEQ ID NO: 801256 - protein, 188 aa, Homo sapiens
SDAWVSFNMAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPACNGTPCGAMCRNRRPRTSSWQMPSWQGGGRWRSCSYRSRPSSRPGRLYTENRGSWLLC

SEQ ID NO: 801257 - protein, 91 aa, Homo sapiens [sequence omitted]

SEQ ID NO: 801258 - protein, 123 aa, Homo sapiens
EGWAFCTGADATTSGVSEPQSPTRIPWSPGGRCVSSIRTVTSWLTTSAFRRPIGASTARSRVSLCWPGRQPQFCSSPGTLLSSSPCPCPDLPALWMWGPHHPSCSQINSRRGKKNKDTKPNQD

SEQ ID NO: 801259 - protein, 213 aa, Homo sapiens; identical to SEQ ID NO: 801246

SEQ ID NO: 801260 - protein, 213 aa, Homo sapiens; identical to SEQ ID NO: 801246

SEQ ID NO: 801261 - protein, 187 aa, Homo sapiens
WTRPITLRDQRRMGWDTFLQKLVAAGYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQREWFPSPFPWPWLGESVFNLH

SEQ ID NO: 801262 - protein, 134 aa, Homo sapiens
MTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 801263 - protein, 169 aa, Homo sapiens
MAGLMLGPPHLCFSPSRHYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 801264 - protein, 134 aa, Homo sapiens; identical to SEQ ID NO: 801262

SEQ ID NO: 801265 - protein, 219 aa, Homo sapiens
SDAWVSFNMAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQVRSPAVQSPAKVQPLCPSRRAAR

SEQ ID NO: 801266 - protein, 106 aa, Homo sapiens
RSHRDTMRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 801267 - protein, 131 aa, Homo sapiens
MATSTSWVQEEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQVRSPAVQSPAKVQPLCPSRRAAR

SEQ ID NO: 801268 - protein, 103 aa, Homo sapiens
VGLEAEPSSTRAFRLLHSLCPVWPSRRPSGIPEKDLHSVMAPYFLQQRDTLRRHVQKQEAENQQLADAVLAGRRQVEELQLQVQAQQQAWQVSVPACLFLFLL

SEQ ID NO: 801269 - protein, 72 aa, Homo sapiens
LEYKIYINVVKIIENNYFILNSGDGIDYSQQKRENIGDLIQETLEAFERYGGENAFINIKYVVPTYESCLLN

SEQ ID NO: 801270 - protein, 132 aa, Homo sapiens
IACFKCDSVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNDLPGCACPEGRIILSCL

SEQ ID NO: 801271 - protein, 257 aa, Homo sapiens
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNVNSGDGIDYSQQKRENIGDLIQETLEAFERYGGENAFINIKYVVPTYESCLLN

SEQ ID NO: 801272 - protein, 209 aa, Homo sapiens
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNGWAPP

SEQ ID NO: 801273 - protein, 112 aa, Homo sapiens
SHPPPHPPPHIFPFPPPFTSGENSLPRLECSGAIMARCNLDHLGSSDPPTSASQVAEIIVNSGDGIDYSQQKRENIGDLIQETLEAFERYGGENAFINIKYVVPTYESCLLN

SEQ ID NO: 801274 - protein, 76 aa, Homo sapiens
LDCVGLFGKLQRSNWPLCVFACTMNSGDGIDYSQQKRENIGDLIQETLEAFERYGGENAFINIKYVVPTYESCLLN

SEQ ID NO: 801275 - protein, 110 aa, Homo sapiens
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVSQGTAVPASCTR

SEQ ID NO: 801276 - protein, 257 aa, Homo sapiens; identical to SEQ ID NO: 801271

SEQ ID NO: 801277 - protein, 269 aa, Homo sapiens
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNVTHRQRSELSSMLAKWGGPDLLLVFLPFSTIIVCKSLIFILSQFMLPRLNSATNNMNVTHFIICN

SEQ ID NO: 801278 - protein, 299 aa, Homo sapiens
MPKRTKLLAQQPLPVHQPHSLVSEGFTVKAMMKNSVVRGPPAAGAFKERPTKPTAFRKFYERGDFPIALEHDSKGNKIAWKILGMKNYKTTSPWPLSNRLKLLTDGSESCLPMNSRIMLEIGKINVKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNVTHRQRSELSSMLAKWGGPDLLLVFLPFSTIIVCKSLIFILSQFMLPRLNSATNNMNVTHFIICN

SEQ ID NO: 801279 - protein, 80 aa, Homo sapiens
SKGHGGAERDARPLLLLRVQDLLLICWTLISLQPSEAAAALLSFRGCHHQKRRLPAAHQLGSSQAVVSTRMSDLEWRWGD

SEQ ID NO: 801280 - protein, 69 aa, Homo sapiens
AARITVVLAAPGRGHLQPASHLLEVQSNNVSKWGVRVEDGLQHCLIIWSPHGAQLQNPKRKDPGHGWET

SEQ ID NO: 801281 - protein, 67 aa, Homo sapiens
REASRPAYVQSYTPDQMPTFFSFFLFCFLSEVQSNNVSKWGVRVEDGLQHCLIIWSPHGAQLQNPKR

SEQ ID NO: 801282 - protein, 67 aa, Homo sapiens
AARITVVLAAPGRGHLQPASHLLEKRPRPWMGDLGQRWKRVLGTRQLLNEEHNCIMENPQHPQTVNT

SEQ ID NO: 801283 - protein, 77 aa, Homo sapiens
GRGSPPPGWSPARAEYPRVPFSPGAGRTQEQAESKRPRPWMGDLGQRWKRVLGTRQLLNEEHNCIMENPQHPQTVNT

SEQ ID NO: 801284 - protein, 258 aa, Homo sapiens
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKGCFEHIGHAIDSYTWGISWFGFAILMWTLPVMLIAMYFYTML

SEQ ID NO: 801285 - protein, 172 aa, Homo sapiens
AAASLPGSPAPSQRCFKPYPLITPCYIKTTTRQLSSPNHSPSQSPNQSPRIKRRPEPSLSRGSRTALASVAAPAKKHRADGGLAAGLSRSADWTEELGARTPRVGGSAHLLERGVASDSGGGVSPALAAKASGAPAAADGFQNVFTGERALLLASGSQVACQSGPSPATRPP

SEQ ID NO: 801286 - protein, 173 aa, Homo sapiens
AAASLPGSPAPSQRCFKPYPLITPCYIKTTTRQLSSPNHSPSQSPNQSPRIKRRPEPSLSRGSRTALASVAAPAKKHRADGGLAAGLSRSADWTEELGARTPRVGGSAHLLERGVASDSGGGVSPALAAKASGAPAAADGFQNVFTGRTLLEKLFSQQENGPPEEAEKFCSRI

SEQ ID NO: 801287 - protein, 284 aa, Homo sapiens
MDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVQNDVHFVSTLEPLSNAVKRNVPRCIIILVLQEPAPFRISVTSSCFVQNTLTKLLKDQKEDANCAVHDSPNGTSSI

SEQ ID NO: 801288 - protein, 374 aa, Homo sapiens
RPRRREPPRRRTGIHVSFLVTRMSSEEDKSVEQPQPPPPPPEEPGAPAPSPAAADKRPRGRPRKDGASPFQRARKKPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVQNDVHFVSTLEPLSNAVKRNVPRCIIILVLQEPAPFRISVTSSCFVQNTLTKLLKDQKEDANCAVHDSPNGTSSI

SEQ ID NO: 801289 - protein, 318 aa, Homo sapiens
LEIPFVYTKMRFPLPESQKEPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVQNDVHFVSTLEPLSNAVKRNVPRCIIILVLQEPAPFRISVTSSCFVQNTLTKLLKDQKEDANCAVHDSPNGTSSI

SEQ ID NO: 801290 - protein, 103 aa, Homo sapiens
MGPHGREGRQCRGCAPEQVPQFFTCKASPEAQTLIESERKKWPVYLLSRVMPNSFSRSQFSPLGSQETISEQEVTSEEERTLGECTEKGQTESPWMKLIKKQT

SEQ ID NO: 801291 - protein, 273 aa, Homo sapiens
MFGFPTATLLDCHGRYAQNVAFFNVMTEAHHKYDHSEATGSSSWDIQNSFRREKLEQKSPDSKTLQEDSPGVRQRVYECQECGKSFRQKGSLTLHERIHTGQKPFECTHCGKSFRAKGNLVTHQRIHTGEKPYQCKECGKSFSQRGSLAVHERLHTGQKPYECAICQRSFRNQSNLAVHRRVHSGEKPYRCDQCGKAFSQKGSLIVHIRVHTGLKPYACTQCRKSFHTRGNCILHGKIHTGETPYLCGQCGKSFTQRGSLAVHQRSCSQRLTL

SEQ ID NO: 801292 - protein, 69 aa, Homo sapiens
PAKLLTEAHPLTTFLVHSQTPSLGEAFSTLAPERESGCAPAKLLTEAHPLTTFLKRSSLYELRVQNPLR

SEQ ID NO: 801293 - protein, 273 aa, Homo sapiens; identical to SEQ ID NO: 801291

SEQ ID NO: 801294 - protein, 277 aa, Homo sapiens
MRSAHRYSVSLFSALVGSLRKQRRPCFDVMTEAHHKYDHSEATGSSSWDIQNSFRREKLEQKSPDSKTLQEDSPGVRQRVYECQECGKSFRQKGSLTLHERIHTGQKPFECTHCGKSFRAKGNLVTHQRIHTGEKPYQCKECGKSFSQRGSLAVHERLHTGQKPYECAICQRSFRNQSNLAVHRRVHSGEKPYRCDQCGKAFSQKGSLIVHIRVHTGLKPYACTQCRKSFHTRGNCILHGKIHTGETPYLCGQCGKSFTQRGSLAVHQRSCSQRLTL

SEQ ID NO: 801295 - protein, 273 aa, Homo sapiens; identical to SEQ ID NO: 801291

SEQ ID NO: 801296 - protein, 173 aa, Homo sapiens
MFGFPTATLLDCHGRYAQNVAFFNVMTEAHHKYDHSEATGSSSWDIQNSFRREKLEQKSPDSKTLQEDSPGVRQRVYECQECGKSFRQKGSLTLHERIHTGQKPFECTHCGKSFRAKGNLVTHQRIHTRGNCILHGKIHTGETPYLCGQCGKSFTQRGSLAVHQRSCSQRLTL

SEQ ID NO: 801297 - protein, 273 aa, Homo sapiens; identical to SEQ ID NO: 801291

SEQ ID NO: 801298 - protein, 273 aa, Homo sapiens; identical to SEQ ID NO: 801291

SEQ ID NO: 801299 - protein, 292 aa, Homo sapiens
PTVEKASGPKAILLHINGYTRERSLISARSVGKASVNEVVSLSTRVHTVHKYDHSEATGSSSWDIQNSFRREKLEQKSPDSKTLQEDSPGVRQRVYECQECGKSFRQKGSLTLHERIHTGQKPFECTHCGKSFRAKGNLVTHQRIHTGEKPYQCKECGKSFSQRGSLAVHERLHTGQKPYECAICQRSFRNQSNLAVHRRVHSGEKPYRCDQCGKAFSQKGSLIVHIRVHTGLKPYACTQCRKSFHTRGNCILHGKIHTGETPYLCGQCGKSFTQRGSLAVHQRSCSQRLTL

SEQ ID NO: 801300 - protein, 171 aa, Homo sapiens
MTEAHHKYDHSEATGSSSWDIQNSFRREKLEQKSPDSKTLQEDSPGVRQRVYECQECGKSFRQKGSLTLHERIHTGQKPFECTHCGKSFRAKGNLVTHQRIHTGEKPYQCKECGKSFSQRGSLAVHERLHTGQKPYECAICQRSFRNQSNLAVHRRVHSGEKPYRCDQCGK

SEQ ID NO: 801301 - protein, 1634 aa, Homo sapiens
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 801302 - protein, 1634 aa, Homo sapiens; identical to SEQ ID NO: 801301

SEQ ID NO: 801303 - protein, 1412 aa, Homo sapiens
MRPWSSPAQLVAGAQPAGRGDPLGPRPIPPPRFRRASSQREPPYPRPAEPALELAGSKCQPDTPAASLCPADSPSQHRVMPPGPASWANVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 801304 - protein, 1427 aa, Homo sapiens
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPR

SEQ ID NO: 801305 - protein, 130 aa, Homo sapiens
MPWQQGRACGGLMTFPSDPFTFPEKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQ

SEQ ID NO: 801306 - protein, 1634 aa, Homo sapiens; identical to SEQ ID NO: 801301

SEQ ID NO: 801307 - protein, 591 aa, Homo sapiens
MLVEAIVLQDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 801308 - protein, 46 aa, Homo sapiens
MLTLQMIRIMSKIWVQEGLDMRMVIFRCFSTGRGRGQLGVGVRVEE

SEQ ID NO: 801309 - protein, 761 aa, Homo sapiens
GGFAVQHQGPCAFYCDLPVGTLSPSRSSMERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 801310 - protein, 715 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLCVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 801311 - protein, 543 aa, Homo sapiens
MLRGKENPKPRKPHPLENLCTIRRFLKLTQHERDVIYEEESRHHHSERMRHVVQLPPEPVQVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLCVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 801312 - protein, 431 aa, Homo sapiens
NALKELLKEMNQSTLAKECPLSQSMISSIVNSTYYANVSATKCQEFGRWYKKYKKIKGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQVQLALNTVINSNTGDRIEIGYNYFYLFKKLYGSQDIELD

SEQ ID NO: 801313 - protein, 716 aa, Homo sapiens
NALKELLKEMNQSTLAKECPLSQSMISSIVNSTYYANVSATKCQEFGRWYKKYKKIKGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLCVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 801314 - protein, 515 aa, Homo sapiens
MISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLCVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 801315 - protein, 471 aa, Homo sapiens
NALKELLKEMNQSTLAKECPLSQSMISSIVNSTYYANVSATKCQEFGRWYKKYKKIKGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAHHAAIYA

SEQ ID NO: 801316 - protein, 315 aa, Homo sapiens
MTGQGQSASGSSAWSTVFRHVRYENLIAGVSGGVLSNLALHPLDLVKIRFAVSDGLELRPKYNGILHCLTTIWKLDGLRGLYQGVTPNIWGAGLSWGLYFFFYNAIKSYKTEGRAERLEATEYLVSAAEAGAMTLCITNPLWVTKTRLMLQYDAVVNSPHRQYKGMFDTLVKIYKYEGVRGLYKGFVPGLFGTSHGALQFMAYELLKLKYNQHINRLPEAQLSTVEYISVAALSKIFAVAATYPYQVVRARLQDQHMFYSGVIDVITKTWRKEGVGGFYKGIAPNLIRVTPACCITFVVYENVSHFLLDLREKRK

SEQ ID NO: 801317 - protein, 183 aa, Homo sapiens
MTLCITNPLWVTKTRLMLQYDAVVNSPHRQYKGMFDTLVKIYKYEGVRGLYKGFVPGLFGTSHGALQFMAYELLKLKYNQHINRLPEAQLSTVEYISVAALSKIFAVAATYPYQVVRARLQDQHMFYSGVIDVITKTWRKEGVGGFYKGIAPNLIRVTPACCITFVVYENVSHFLLDLREKRK

SEQ ID NO: 801318 - protein, 183 aa, Homo sapiens; identical to SEQ ID NO: 801317

SEQ ID NO: 801319 - protein, 235 aa, Homo sapiens
MTGQGQSASGSSAWSTVFRHVRYENLIAGVSGGVLSNLALHPLDLVKIRFAVSDGLELRPKYNGILHCLTTIWKLDGLRGLYQGVTPNIWGAGLSWGLYFFFYNAIKSYKTEGRAERLEATEYLVSAAEAGAMTLCITNPLWVTKTRLMLQYDAVVNSPHRQYKGMFDTLVKIYKYEGVRGLYKGFVPGLFGTSHGALQFMAYELLKLKYNQHINRLPEAQLERRRRWILQGNCS

SEQ ID NO: 801320 - protein, 315 aa, Homo sapiens; identical to SEQ ID NO: 801316

SEQ ID NO: 801321 - protein, 283 aa, Homo sapiens
TRGSGRVGRRSTSVKIRFAVSDGLELRPKYNGILHCLTTIWKLDGLRGLYQGVTPNIWGAGLSWGLYFFFYNAIKSYKTEGRAERLEATEYLVSAAEAGAMTLCITNPLWVTKTRLMLQYDAVVNSPHRQYKGMFDTLVKIYKYEGVRGLYKGFVPGLFGTSHGALQFMAYELLKLKYNQHINRLPEAQLSTVEYISVAALSKIFAVAATYPYQVVRARLQDQHMFYSGVIDVITKTWRKEGVGGFYKGIAPNLIRVTPACCITFVVYENVSHFLLDLREKRK

SEQ ID NO: 801322 - protein, 315 aa, Homo sapiens; identical to SEQ ID NO: 801316

SEQ ID NO: 801323 - protein, 182 aa, Homo sapiens
GRGGGAAPRGGGARSPQTARGRGRPGRAAAGAAGGGCAAEGEGRGSGRRLCWSPTSRRPPPAGSQALVGAEHPAAPDPPAGAHQAQLRLRTAGRHLHCPGITERADSTASSEGRPYQSPASAWASPLRQLHCLCWSEGAACHGGSHLPGGPHRHRLQRSRGLLAAAALGHPLLGLPFSLCRR

SEQ ID NO: 801324 - protein, 182 aa, Homo sapiens; identical to SEQ ID NO: 801323

SEQ ID NO: 801325 - protein, 148 aa, Homo sapiens
MPSRCVQLQRIPLSAVYRICLGKFTFPGMSLDKRQGEGLRIYWGSPEEQSLLSRWNPWSTEVPYATFTEHPMKYTSEKFLEICKLSGFMSKLVPAIQNAHKNSTGSGRGKKLMVLTEPILIETYTGLMSFIGNRNKLGYSLARGSIGF

SEQ ID NO: 801326 - protein, 148 aa, Homo sapiens; identical to SEQ ID NO: 801325

SEQ ID NO: 801327 - protein, 148 aa, Homo sapiens; identical to SEQ ID NO: 801325

SEQ ID NO: 801328 - protein, 148 aa, Homo sapiens; identical to SEQ ID NO: 801325

SEQ ID NO: 801329 - protein, 148 aa, Homo sapiens; identical to SEQ ID NO: 801325

SEQ ID NO: 801330 - protein, 148 aa, Homo sapiens; identical to SEQ ID NO: 801325

SEQ ID NO: 801331 - protein, 85 aa, Homo sapiens
MPSRCVQLQRIPLSAVYRICLGKFTFPGMSLDKRQGEGLRIYWGSPEEQSLLSRWNPWSTEVPYATFTEHPMKYTSEKFLEICKQ

SEQ ID NO: 801332 - protein, 255 aa, Homo sapiens
IEVGEKNAASNILIDGHMEGEIWGLATHPSKDLFISASNDGTARIWDLADKKLLNKVSLGHAARCAAYSPDGEMVAIGMKNGEFVILLVNSLKVWGKKRDRKSAIQDIRISPDNRFLAVGSSEHTVDFYDLTQGTNLNRIGYCKDIPSFVIQMDFSADGKYIQRLGDEVIGIWPRNADKADVNCACVTHAGLNIVTGDDFGLVKLFDFPCTEKFAKHKRYFGHSAHVTNIRFSYDDKYVVSTGGDDCSVFVWRCL

SEQ ID NO: 801333 - protein, 255 aa, Homo sapiens; identical to SEQ ID NO: 801332

SEQ ID NO: 801334 - protein, 116 aa, Homo sapiens
EVPLGKQVTEAVVIEKITWASWTSVLGDEVIGIWPRNADKADVNCACVTHAGLNIVTGDDFGLVKLFDFPCTEKFAKHKRYFGHSAHVTNIRFSYDDKYVVSTGGDDCSVFVWRCL

SEQ ID NO: 801335 - protein, 36 aa, Homo sapiens
MGITIRTSSRCEAGCKWPRPGAARTTVIRAAAGGLG

SEQ ID NO: 801336 - protein, 102 aa, Homo sapiens
LASADPRPARLVGPAGALEDLERAVELSGGRGRAARQSFVQRGLLARLQGRDDDARRDFERAARLGSPFARRQLVLLNPYAALCNRMLADMMGQLRRPRDSR

SEQ ID NO: 801337 - protein, 151 aa, Homo sapiens
PDEVFPQAQLEQSKALELQGVMAAEAGDLSTALERFGQAICLLPERASAYNNRAQARRLQGDVAGALEDLERAVELSGGRGRAARQSFVQRGLLARLQGRDDDARRDFERAARLGSPFARRQLVLLNPYAALCNRMLADMMGQLRRPRDSR

SEQ ID NO: 801338 - protein, 109 aa, Homo sapiens [sequence omitted]

SEQ ID NO: 801339 - protein, 346 aa, Homo sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 801340 - protein, 185 aa, Homo sapiens
MDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 801341 - protein, 240 aa, Homo sapiens
CSRGPDCEIGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 801342 - protein, 346 aa, Homo sapiens; identical to SEQ ID NO: 801339

SEQ ID NO: 801343 - protein, 109 aa, Homo sapiens [sequence omitted]

SEQ ID NO: 801344 - protein, 185 aa, Homo sapiens; identical to SEQ ID NO: 801340

SEQ ID NO: 801345 - protein, 67 aa, Homo sapiens
ADGRAHAAFAAGSVCWGANTPRSSREPPPGHHFTLFRYSNLISKVLDSAKEGIYLKKKKKKTPSFDS

SEQ ID NO: 801346 - protein, 102 aa, Homo sapiens
MCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPVIM

SEQ ID NO: 801347 - protein, 102 aa, Homo sapiens
MCSGSGRRRSSLSPTMRPGTGAERGGLMMGHPGMHYAPMGMHPMGQRANMPPVPHGMMPQMMPPMGGPPMGQKDKIKQFATARCFSLFWGLLFPLGQSRCLE

SEQ ID NO: 801348 - protein, 144 aa, Homo sapiens
MCSGSGRRRSSLSPTMRPGTGAERGGLMVSEMESHPPSQGPGDGERRLSGSSLCSGSWVSADGFLRRRPSMGHPGMHYAPMGMHPMGQRANMPPVPHGMMPQMMPPMGGPPMGQMPGMMSSVMPGMMMSHMSQASMQPALPVIM

SEQ ID NO: 801349 - protein, 119 aa, Homo sapiens
MCSGSGRRRSSLSPTMRPGTGAERGGLMMGHPGMHYAPMGMHPMGQRANMPPVPHGMMPQMMPPMGGPPMGQKDKIKQFATARCFSLFWGLLFPLGQSSSCYHMSPSRHSPMPRLFNSF

SEQ ID NO: 801350 - protein, 184 aa, Homo sapiens
MCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEIPEYHCCWKSYYKIKPACNDQS

SEQ ID NO: 801351 - protein, 79 aa, Homo sapiens
HGFAGAVQLGLIGTWEQAMKMIINDPRYSALAKLSEKKQAFNAYKVQTEKEEKEEARSKYKEAKESFQRFLEIYMNKRM

SEQ ID NO: 801352 - protein, 108 aa, Homo sapiens
LRSLLVGMCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPLN

SEQ ID NO: 801353 - protein, 119 aa, Homo sapiens
AYYYYTAVRRRQKGRKTVFNNQVGGQTWWLTPIIPTVWEAKASRWLEPRSSRPALATWQNPVSRGKKKNTKISRAWWHVPVVPPPWEAEVERSLEPGNVKAAVSHNCTTALQGDSETLS

SEQ ID NO: 801354 - protein, 452 aa, Homo sapiens
MCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEGYQNTIVAGSLITKSNLHAMIKAEESSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVADFTPKKEEEESQPAKKTYTWNTKEEAKQAFKELLKEKRVPSNASWEQAMKMIINDPRYSALAKLSEKKQAFNAYKVQTEKEEKEEARSKYKEAKESFQRFLEIYMNKRM

SEQ ID NO: 801355 - protein, 198 aa, Homo sapiens
MCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEGTSTTY

SEQ ID NO: 801356 - protein, 83 aa, Homo sapiens
AAAAAANANASTSASNTVSGTVPVVPEPEVTSIVATVVDNENTVTISTEEQAQLTSTPAIQDQSVEVSSNTGEETSKQETVAE

SEQ ID NO: 801357 - protein, 522 aa, Homo sapiens
RAASGLQPCSGAGAEPAANPRSPRSLVPSLESTSTSVPPAPGTMATDSWALAVDEQEAAAESLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 801358 - protein, 370 aa, Homo sapiens
MGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 801359 - protein, 491 aa, Homo sapiens
RAASGLQPCSGAGAEPAANPRSPRSLVPSLESTSTSVPPAPGTMATDSWALAVDEQEAAAESLSNLHLKEEKIKPDTNGAVVKTNANAEKTDEEEKEDRAAQSLLNKLIRSNLVDNTNQVEVLQRDPNSPLYSVKSFEELRLPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 801360 - protein, 484 aa, Homo sapiens
MAGAAGRVQDRALRRFPITLPVGDLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 801361 - protein, 474 aa, Homo sapiens
GKAALTWLMQLREKLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 801362 - protein, 328 aa, Homo sapiens
MLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 801363 - protein, 370 aa, Homo sapiens; identical to SEQ ID NO: 801358

SEQ ID NO: 801364 - protein, 315 aa, Homo sapiens
APLPVCSLVVGLEQSLPRTPGAHDPSCHPSNPPARASHPRLGPWPLTHGPWRWTSRKLRLSRPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKSAVYSTGTPWQPRLRLAHVRRPTRPGSRGMASGVPREIDQPPNISPRANGGGGAYDEKPPCTR

SEQ ID NO: 801365 - protein, 370 aa, Homo sapiens; identical to SEQ ID NO: 801358

SEQ ID NO: 801366 - protein, 328 aa, Homo sapiens; identical to SEQ ID NO: 801362

SEQ ID NO: 801367 - protein, 221 aa, Homo sapiens
REPRLGVETGRELELEVKHEDVTECCNLMIKFEMDEECFLGMSKESGFSRWNLLVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPGQLNYLGSSHQIWHILAVV

SEQ ID NO: 801368 - protein, 361 aa, Homo sapiens
PGPPRRWRRVAGVSAEPGPGQQRQRGRTSRSVRGLRGGGASGEDPPPRGGGTWVELPSLGSWWRTGTMHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPALKSYFRIRNEDSGNVCHILWHPTWTEYPI

SEQ ID NO: 801369 - protein, 306 aa, Homo sapiens
PGPPRRWRRVAGVSAEPGPGQQRQRGRTSRSVRGLRGGGASGEAPSPGRRDLGELPSLGSWWRTGTMHQKLLKSAHYIELGSYQYWPVLVPRGIRLYTYEQIPGSLKDNPYITRRLPGLPAVQAVYQKVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPALKSYFRIRNEDSGNVCHILWHPTWTEYPI

SEQ ID NO: 801370 - protein, 361 aa, Homo sapiens; identical to SEQ ID NO: 801368

SEQ ID NO: 801371 - protein, 355 aa, Homo sapiens
PGPPRRWRRVAGVSAEPGPGQQRQRGRTSRSVRGLRGGGASGEDPPPRGGGTWVELPSLGSWWRTGTMHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQNQERRFRECLSHLMASHLDRISDLKIVIDFRKTVQLSIWQCLREVPKPKINQAE

SEQ ID NO: 801372 - protein, 170 aa, Homo sapiens
MLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQNQERRFRECLSHLMASHLDRISDLKIVIDFRKTVQLSIWQCLREVPKPKINQAE

SEQ ID NO: 801373 - protein, 361 aa, Homo sapiens; identical to SEQ ID NO: 801368

SEQ ID NO: 801374 - protein, 697 aa, Homo sapiens
PRQASPPAPRSAAATVTATARSRPKPRPCAERSGAASTRAQPAGAAGAGPGSSADLPFSGREPESGRPGSGWARAHGKRGLPGPWGPCHVRQARAGGPAMAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKVYFTATSHPREGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSSPEPEPPGPAPQLPLAVATDNFISTCSSASQPWSPRSGPVLNNNPPAVVVNSPQGWAGEPWNRAQHSLPRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 801375 - protein, 782 aa, Homo sapiens
PRQASPPAPRSAAATVTATARSRPKPRPCAERSGAASTRAQPAGAAGAGPGSSADLPFSGREPESGRPGSGWARAHGKRGLPGPWGPCHVRQARAGGPAMAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREMNVPVPPKSPRVPLSDGPQSPRDVSLGERREFTSSPFAWGGCLNRMLLTTLPLPLQEGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSSPEPEPPGPAPQLPLAVATDNFISTCSSASQPWSPRSGPVLNNNPPAVVVNSPQGWAGEPWNRAQHSLPRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 801376 - protein, 306 aa, Homo sapiens
PRQASPPAPRSAAATVTATARSRPKPRPCAERSGAASTRAQPAGAAGAGPGSSADLPFSGREPESGRPGSGWARAHGKRGLPGPWGPCHVRQARAGGPAMAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYR

SEQ ID NO: 801377 - protein, 725 aa, Homo sapiens
PRQASPPAPRSAAATVTATARSRPKPRPCAERSGAASTRAQPAGAAGAGPGSSADLPFSGREPESGRPGSGWARAHGKRGLPGPWGPCHVRQARAGGPAMAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSSPEPEPPGPAPQLPLAVATDNFISTCSSASQPWSPRSGPVLNNNPPAVVVNSPQGWAGEPWNRAQHSLPRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 801378 - protein, 656 aa, Homo sapiens
PRQASPPAPRSAAATVTATARSRPKPRPCAERSGAASTRAQPAGAAGAGPGSSADLPFSGREPESGRPGSGWARAHGKRGLPGPWGPCHVRQARAGGPAMAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 801379 - protein, 487 aa, Homo sapiens
PRQASPPAPRSAAATVTATARSRPKPRPCAERSGAASTRAQPAGAAGAGPGSSADLPFSGREPESGRPGSGWARAHGKRGLPGPWGPCHVRQARAGGPAMAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPLTGFLPKWAIIEEFTKNNSLIIPTS

SEQ ID NO: 801380 - protein, 43 aa, Homo sapiens
SNAEDSDSRLLYLQALLQEGVPLPRFPGQIPGFPEAGQTSSCP

SEQ ID NO: 801381 - protein, 725 aa, Homo sapiens; identical to SEQ ID NO: 801377

SEQ ID NO: 801382 - protein, 403 aa, Homo sapiens
MAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSSPEPEPPGPAPQLPLAVATDNFISTCSSASQPWSPRSGPVLNNNPPAVVVNSPQGWAGEPWNRAQHSLPRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 801383 - protein, 725 aa, Homo sapiens; identical to SEQ ID NO: 801377

SEQ ID NO: 801384 - protein, 697 aa, Homo sapiens
PRQASPPAPRSAAATVTATARSRPKPRPCAERSGAASTRAQPAGAAGAGPGSSADLPFSGREPESGRPGSGWARAHGKRGLPGPWGPCHVRQARAGGPAMAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSSPEPEPPGPAPQLPLAVATDNFISTCSSASQPWSPRSGPVLNNNPPAVVVNSPQGWAGEPWNRAQHSLPRCLGPFSFGFLSMCPRPTPAVARYRNLNCEAGSLLCHRGHHAKPPTPSLQLPGARS

SEQ ID NO: 801385 - protein, 355 aa, Homo sapiens
PRQASPPAPRSAAATVTATARSRPKPRPCAERSGAASTRAQPAGAAGAGPGSSADLPFSGREPESGRPGSGWARAHGKRGLPGPWGPCHVRQARAGGPAMAGERPPLRGPGPGPGEVPGEGPPGPGGTGGGPGRGRPSSYRALRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREGARKEPLAVVGSPYWMAPEVLRGELYDEKVRHQPFRSPRPSETLEVFS

SEQ ID NO: 801386 - protein, 600 aa, Homo sapiens
LDDCQKLIEHGVNTAEDLVREGEIAMLGGVGEENGKLWSFTKKASHIQLDSLPEVPLLVDVPCLSAQLDDSILNIVKDHIFKHGTVASRPPVQIEELIEKPGGIIVRWCKVDDDFTAQDYRLQFRKCTSNHFEDVYVGSETEFIVLHIDPNVDYQFKSAPEEMELEPELLLQEARENVEAAQSYRRELGHRLEGLREARRQIKESASQTRDVLKQHFNDLKGTLGKLLDERLVTLLQEVDTIEQETIKPLDDCQKLIEHGVNTAEDLVREGEIAMLGGVGEENEKLWSFTKKASHIQLDSLPEVPLLVDVPCLSAQLDDSILNIVKDHIFKHGTVASRPPVQIEELIEKPGGIIVRWCKVDDDFTAQDYRLQFRKCTSNHFEDVYVGSETEFIVLHIDPNVDYQFRVCARGDGRQEWSPWSVPQIGHSTLVPHEWTAGFEGYSLSSRRNIALRNDSESSGVLYSRAPTYFCGQTLTFRVETVGQPDRRDSIGVCAEKQDGYDSLQRDQAVCISTNGAVFVNGKEMTNQLPAVTSGSTVTFDIEAVTLGTTSNNEGGHFKLRVTISSNNREVVFDWLLDQSCGSLYFGCSFFYPGWKVLVF

SEQ ID NO: 801387 - protein, 406 aa, Homo sapiens
VAFRGVPEVPFTSQTRDVLKQHFNDLKGTLGKLLDERLVTLLQEVDTIEQETIKPLDDCQKLIEHGVNTAEDLVREGEIAMLGGVGEENEKLWSFTKKASHIQLDSLPEVPLLVDVPCLSAQLDDSILNIVKDHIFKHGTVASRPPVQIEELIEKPGGIIVRWCKVDDDFTAQDYRLQFRKCTSNHFEDVYVGSETEFIVLHIDPNVDYQFRVCARGDGRQEWSPWSVPQIGHSTLVPHEWTAGFEGYSLSSRRNIALRNDSESSGVLYSRAPTYFCGQTLTFRVETVGQPDRRDSIGVCAEKQDGYDSLQRDQAVCISTNGAVFVNGKEMTNQLPAVTSGSTVTFDIEAVTLGTTSNNEGGHFKLRVTISSNNREVVFDWLLDQSCGSLYFGCSFFYPGWKVLVF

SEQ ID NO: 801388 - protein, 438 aa, Homo sapiens
MELEPELLLQEARENVEAAQSYRRELGHRLEGLREARRQIKESASQTRDVLKQHFNDLKGTLGKLLDERLVTLLQEVDTIEQETIKPLDDCQKLIEHGVNTAEDLVREGEIAMLGGVGEENEKLWSFTKKASHIQLDSLPEVPLLVDVPCLSAQLDDSILNIVKDHIFKHGTVASRPPVQIEELIEKPGGIIVRWCKVDDDFTAQDYRLQFRKCTSNHFEDVYVGSETEFIVLHIDPNVDYQFRVCARGDGRQEWSPWSVPQIGHSTLVPHEWTAGFEGYSLSSRRNIALRNDSESSGVLYSRAPTYFCGQTLTFRVETVGQPDRRDSIGVCAEKQDGYDSLQRDQAVCISTNGAVFVNGKEMTNQLPAVTSGSTVTFDIEAVTLGTTSNNEGGHFKLRVTISSNNREVVFDWLLDQSCGSLYFGCSFFYPGWKVLVF

SEQ ID NO: 801389 - protein, 236 aa, Homo sapiens
SACARPRRAAWRRPVQSGTRARFRRPRGQMRGAMELEPELLLQEARENVEAAQSYRRELGHRLEGLREARRQIKESASQTRDVLKQHFNDLKGTLGKLLDERLVTLLQEVDTIEQETIKPLDDCQKLIEHGVNTAEDLVREGEIAMLGGVGEENEKLWSFTKKASHIQLDSLPEVPLLVDVPCLSAQLDDSILNIVKDHIFKHGTVASRPPVQIEELIEKPGGIIVRWCKVCNSEF

SEQ ID NO: 801390 - protein, 1157 aa, Homo sapiens
MTYVYSTDFKTMVNFNLHSQNDSAFKKFFYFLKHKNVDQNLVYLGQWRLFQFYKGNLRTANPTTWCVIVSYVIGKGSLYRFHWRQCGLEYLYGAYMNLQNASQKPDWLVGNKVRPYEMNCKLYIAQVLIAFSRGIQSFYKFMHTFFTRGYPQQPLENCTSLKTVTGLSLTLPSGLLIMRSWGQIDYVTGCSPCNSYLSASATALQCHLFINSCLKKIGREAFFFLFFFFNHTLWKNISRDSKFQKGGQILEVSISSFLKIWFEPYAHSLTFPFLLSFLFLCGSELSDIKMHVKSMYVLEGKVLAFETEVKWAQVAPAAVPSLSTLARSRSGSRSMRIDPQKNHFNSICYSIAYEDVKCELPVLLVDSSHNCPRPWSTHPGAEPALTHALLWCLGSCAGTLAQAGEGRPGGRGLVLLLEYRGLKCSFLHNVSVIAVTKAASSRKPGMELGDRYLSMTEIITIKEHLGESGHLISEFLSSGASVLTMLWVLTCLFHKSLAFSGQSVFDQKWPFGLVALAMLQGYEASPFTFQTMESVYGFRKRTLWLRGQLPVTFNQLHHFLNRYLLKKSVILFIEADCSKALKYDNLCSSNCSRMGTHPGLLNFTVPLGKEQGPLEFPSVSLSPFHKSLPVGATTPSLGLSTFNTSLIPFPGFLPSQLQVVLTESISSASCQSLEKSLRKTMRVGHKDMGPHICFGFAGNSGLGVFHVTCIGIFEDSILLEKKVRVVFLSLKPTVNGMIVASSEIPWPPEIKHGAMAPLSNLLSGRFLSPASYRPNLRAREHGGRVVLARTICLSYLVDSYPLSFMETHFLISETVAELATYLGLNWRRGDIFLISEMLSDFPLPGHCLTCTLQTQVSGKLVCLDTELRFCSAPFSSILSGSSSSSWSLNLMLIVLRTKMGPEDTKMSSTVSALRNRLRDFTRSVQYLISGEVTTAAVREEEPLSTDFGRNLFFVVCLFVCLFVCLRQGLALYPGWGAMARSWLTATSASWVQVILLPQPPEELGLQVRATTPSYFCIFSRDGVSLCWPGWSRTPDLMICPLSLPKCWDYKCEPPHLAWKEPLKISLRLVILFCDGGHWRELLFQSIMSSHWTLKILLVPLFYLSLEFPSGLYYVWQMTWVITFPPGLDHRSWKLLREHFAPTKDQILEPHIIDFISL

SEQ ID NO: 801391 - protein, 1068 aa, Homo sapiens
MCTEKINIPIGPCGGMCLSVKRRCEPVLKEFGFAWPESLNCSKFPPQNDHNHMCMEGPGDEEVPLPHKTPIQPGEECHSVGTNSDQYIWVKRSLNCVLKCGYDAGLYSRSAKEFTDIWMAVWASLCFISTAFTVLTFLIDSSRFSYPERPIIFLSMCYNIYSIAYIVRLTVGRERISCDFEEAAEPVLIQEGLKNTGCAIIFLLMYFFGMASSIWWVILTLTWFLAAGLKWGHEAIEMHSSYFHIAAWAIPAVKTIVILIMRLVDADELTGLCYVGNQNLDALTGFVVAPLFTYLVIGTLFIAAGLVALFKIRSNLQKDGTKTDKLERLMVKIGVFSVLYTVPATCVIACYFYEISNWALFRYSADDSNMAVEMLKIFMSLLVGITSGMWIWSAKTLHTWQKCSNRLVNSGKVKREKRGNGWVKLEKAVRLWYKASQPPCFLHFEGGNASILEEILLKVLCSESQFEQTQQQLSDPRQPTASHPDPSIKKPMILLQTLEDPKWKSQLEAFKAVKNQNVDHFSRLQLGAWRSCLDSRKSRAILFSPAGWDLSCELVTAGRNINFFNPFTILNTNWVFQIAKQSINTGNAGFRKVLQEFYSLADEHKHLLWCAVCCLELCGLHSQEVVLESFSAFVIKQLFEQTKVLYSHNIRYPVDFSSLSSSLKFQHLSSWLLLFSSFYVNDFKKGIFIEFLYCSMLKEGKRKGDSLSDNHLIQRKMRFTKLTYLTDPRDLIALSSGDLIYFTCVIASMQTPVWKSRNVKFLGNFAFTQIELCNFCVSITIKSTLLDHDIVYSTDFKTMVNFNLHSQNDSAFEKFFYFLKHKNVIRIWSTYDNGDFFSFIKGTEDSYSNYLVRNCFLVIGKGSLKISLEAVWPGVFIWCLMNLQNASQKPDWLVGNKVRPYEMNCKLYIAQVLIAFSRGIQKLLKFMHTFFTRGYPQQPLENCTSLKTVTGLSLTLPSGLLIMRSWGQIDYVTGCSPCNSYLSASATALQCHLFINSCLKKIGREAFFFLFFFFNHTLWKNISRDSKFQKGGQILEVSISSFLKIWFEPYAHSLTFPFLLSFLFLCGS

SEQ ID NO: 801392 - protein, 1068 aa, Homo sapiens; identical to SEQ ID NO: 801391

SEQ ID NO: 801393 - protein, 122 aa, Homo sapiens
MAWRGAGPSVPGAPGGVGLSLGLLLQLLLLLGPARGFGDEEERRCDPIRISMCQNLGYNVTKMPNLVGHELQTDAELQLTTFTPLIQYGCSSQLQVGAPTPTPGGTPWGGTLQTNFAEPMPS

SEQ ID NO: 801394 - protein, 122 aa, Homo sapiens; identical to SEQ ID NO: 801393

SEQ ID NO: 801395 - protein, 1068 aa, Homo sapiens; identical to SEQ ID NO: 801391

SEQ ID NO: 801396 - protein, 1068 aa, Homo sapiens; identical to SEQ ID NO: 801391

SEQ ID NO: 801397 - protein, 122 aa, Homo sapiens; identical to SEQ ID NO: 801393

SEQ ID NO: 801398 - protein, 187 aa, Homo sapiens
MATEPGGTPRGRRPPPLPNGPCAGGDGKREGGGAGEGRRGGARRPPARLGPAPRPRVPAWSPRPAGRRALPAGILGPPSQSSRLAPRPRDPCVSQDGGAGLGVTTGDDGAFSLRQDPTHQASLARAPLRRVAIRQRGRPPSAAYLRFTSADPVLRSVLQCAVLCCTHFCAYLLVQYALLCTVCPLCM

SEQ ID NO: 801399 - protein, 585 aa, Homo sapiens
MENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 801400 - protein, 585 aa, Homo sapiens; identical to SEQ ID NO: 801399

SEQ ID NO: 801401 - protein, 585 aa, Homo sapiens; identical to SEQ ID NO: 801399

SEQ ID NO: 801402 - protein, 585 aa, Homo sapiens; identical to SEQ ID NO: 801399

SEQ ID NO: 801403 - protein, 852 aa, Homo sapiens
MKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 801404 - protein, 852 aa, Homo sapiens
MKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLGFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 801405 - protein, 585 aa, Homo sapiens; identical to SEQ ID NO: 801399

SEQ ID NO: 801406 - protein, 852 aa, Homo sapiens; identical to SEQ ID NO: 801403

SEQ ID NO: 801407 - protein, 585 aa, Homo sapiens; identical to SEQ ID NO: 801399

SEQ ID NO: 801408 - protein, 585 aa, Homo sapiens; identical to SEQ ID NO: 801399

SEQ ID NO: 801409 - protein, 852 aa, Homo sapiens; identical to SEQ ID NO: 801403

SEQ ID NO: 801410 - protein, 852 aa, Homo sapiens
MLLIPPRYRHSVRTDGCNGAASLPIPIKNMTILRFQAPSRNFSQEFHTNCQRKKCRPKTSPCVVLIPLPAYCNFFSLTFRQCLKGHLYPSHPSMSHCIIQKHTFHLLPHLSPFTSTVLVCKELPGEGRGFYKYRVPSLFSPPRYGLAFINRHCKILMQVWGRYHCERLLMHGSFTESTVFKDPYNLLIAKISNIYNLDNTLAWAVASLATCFSIPVYPDFRWILLQFCLKSLPVLAQFPLVNLSHSQRFFPNPISFAQTSVSGISLLPHSQSPKNKILHLASLSTDHSLFLFKKCNLHPNHQNLSFLNVSQVVTSFPLNLSHHSFLLYTALTGPDPLTHPDILSSCLISLPDSHLPLPILFIVLEHYLANFNILCIQCLHRLPPHCPFQFGLVLHTFLAAFLPSIFTCHISQILFMTRYLKYLIHEDFINPQSASNASVVAQHNGVHFLVEQEESLGFLQSVLGSPLDTLSTFQLRNFLTSFFLLITFAWSVSKFMIETVIFKKKKQTILPFTCYYLHLSVILSVLPPKLLKMTEHAVECSEVSYFIHFLHKCIGICISILPKHQLLKRLLFPHEWSWYPCQRTVDHKYKTFWILSLTPLPYMSVVIPAPHCLDCCSLVVSLDLGCASPPFFFFFSPKSFCLFWVPCIAYEFLYDHCVNSCKTAGILIGISVELVDKFEKITAILMVLGFLFHDCGMSLHLLRSLFQCCFRDFSVQSLDVFNFFLSILLMPLELYDYFLIFIFVFITGVRNKINFCILILYIVAFLKFFFCHLVFFAYEICICEQKYFYFFLSSLDSYYFIFLPYVLASTSSTILDRSDKSRHLFLVPDFKGKAFSLSPLSMMLASCGFASS

SEQ ID NO: 801411 - protein, 545 aa, Homo sapiens
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRVSWAARLKT

SEQ ID NO: 801412 - protein, 346 aa, Homo sapiens
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPGLGLPGQVDLTAATNSSNSSTVKAIQFPAFTN

SEQ ID NO: 801413 - protein, 168 aa, Homo sapiens
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSVVAAAAQAGGDDRSGEPQSDDIEASRMKRAAAKHLIERYYHQLTEGCGNEACTNECASCPTL

SEQ ID NO: 801414 - protein, 852 aa, Homo sapiens; identical to SEQ ID NO: 801403

SEQ ID NO: 801415 - protein, 1001 aa, Homo sapiens
MSLNNKEEQNIDILTTVDTSSTPNVMLLKYFFCPGTLLYILVFFELDLNLQEALEGKKGTINKVTGFPNKCKLFYTFYYYRTFQTYIKHENSLQPNFSGPWQLQQMSWSSSPWFPETTTFGDACLYREMIDREIHIKKKLEKGFEQNLPMLLIPPRYRHSVRTDGCNGAASLPIPIKNMTILRFQAPSRNFSQEFHTNCQRKKCRPKTSPCVVLIPLPAYCNFFSLTFRQCLKGHLYPSHPSMSHCIIQKHTFHLLPHLSPFTSTVLVCKELPGEGRGFYKYRVPSLFSLPVSGLAFINRHCKILMQVWGRYHCERLLMHGSFTESTVFKDPYNLLIAKISNIYNLDNTLAWAVASLATCFSIPVYPDFRWILLQFCLKSLPVLAQFPLVNLSHSQRFFPNPISFAQTSVSGISLLPHQSVVLKTKFFILHLYRPTILCFFLRNVTFTPIIKISHSSIVTGCHFFPPKPLPSFLPSFTALTGPDPLTHPDILSSCLISLPDSHLPLPILFIVLEHYLANFNILCIQCLHRLPPHCPFQFGLVLHTFLAAFLPSIFTCHISQILFMTRYLKYLIHEDFINPQSASNASVVAQHNGVHFLVEQEESLGFLQSVLGSPLDTLSTFQLRNFLTSFFLLITFAWSVSKFMIETVIFKKKKQTILPFTCYYLHLSVILSVLPPKLLKMTEHAVECSEVSYFIHFLHKCIGICISILPKHQLLKRLLFPHEWSWYPCQRTVDHKYKTFWILSLTPLPYMSVVIPAPHCLDCCSLVVSLDLGCASPPFFFFFSPKSFCLFWVPCIAYEFLYDHCVNSCKTAGILIGISVELVDKFEKYTAILMVLGFLFHDCGMSLHLLRSLFQCCFRDFSVQSLDVFNFFLSILLMPLELYDYFLIFIFVFITGVRNKINFCILILYIVAFLKFFFCHLVFLHMRSCICEQKYFYFFLSSLDSYYFIFFLSVLASTSSTILDRSDKSRHLFLVPDFKGKAFSLSPLSMMLASCGFASS

SEQ ID NO: 801416 - protein, 807 aa, Homo sapiens
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIRELWEVVQSIAVDQCRLTARESA

SEQ ID NO: 801417 - protein, 132 aa, Homo sapiens
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKGKMFYFQLRIVA

SEQ ID NO: 801418 - protein, 168 aa, Homo sapiens [sequence omitted]

SEQ ID NO: 801419 - protein, 585 aa, Homo sapiens; identical to SEQ ID NO: 801399

SEQ ID NO: 801420 - protein, 585 aa, Homo sapiens; identical to SEQ ID NO: 801399

SEQ ID NO: 801421 - protein, 585 aa, Homo sapiens; identical to SEQ ID NO: 801399

SEQ ID NO: 801422 - protein, 585 aa, Homo sapiens; identical to SEQ ID NO: 801399

SEQ ID NO: 801423 - protein, 852 aa, Homo sapiens [sequence omitted]

SEQ ID NO: 801424 - protein, 585 aa, Homo sapiens; identical to SEQ ID NO: 801399

SEQ ID NO: 801425 - protein, 292 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAVGPKAEDPYPPPLTWFFCWGPPHYHLKVGSGLVPLMTKSPVPCFLGANQYLWPGSTEYEDSGTRLDGLSFC

SEQ ID NO: 801426 - protein, 308 aa, Homo sapiens [sequence omitted]

SEQ ID NO: 801427 - protein, 153 aa, Homo sapiens
MPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801428 - protein, 85 aa, Homo sapiens
CWILKEFRDYPPFTWLFLLVSCPNYTYEVGSWIGFAIMTQCLPVALFSLVGFTQMTIWAKGKHRSYLKEFRDYPPLRMPIIPFLL

SEQ ID NO: 801429 - protein, 308 aa, Homo sapiens [sequence omitted]

SEQ ID NO: 801430 - protein, 308 aa, Homo sapiens [sequence omitted]

SEQ ID NO: 801431 - protein, 308 aa, Homo sapiens [sequence omitted]

SEQ ID NO: 801432 - protein, 308 aa, Homo sapiens [sequence omitted]

SEQ ID NO: 801433 - protein, 308 aa, Homo sapiens [sequence omitted]

SEQ ID NO: 801434 - protein, 327 aa, Homo sapiens
TFFASYSLMKHYEGGDSGRKDKGEAVFLGQELTSLRLCFPQVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801435 - protein, 292 aa, Homo sapiens
RRTSWRPPARRTVAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801436 - protein, 282 aa, Homo sapiens
EVTLPDPYTSLMTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801437 - protein, 306 aa, Homo sapiens
LHLAMKDLLTNSLSFLTNLRVPPPMQATSPPSSLNVVPSPPSKGNIPYPSRLFSLQEKRRDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801438 - protein, 336 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVQYVGQVGGGKGKAEDLPDQPQLSLLPPTSLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801439 - protein, 335 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGRVPVLGAGGQLGWVRGSDFLLLSCLPGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801440 - protein, 134 aa, Homo sapiens
MAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801441 - protein, 241 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVGPRRGRSHTPPRTPSRGSSCWCPAPTTPTRWGPGSVSPS

SEQ ID NO: 801442 - protein, 170 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKRGDPHRT

SEQ ID NO: 801443 - protein, 89 aa, Homo sapiens
KKKKYRPNPGWVYCAAQLGSSSRGAVAAVGGSHEALRGKKRETGAVWPLLTHSFSFFAGPRDPTFWSCAPKEEPDGAGAVGKRCAPGHS

SEQ ID NO: 801444 - protein, 154 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHSSPAPGIKPACPSRKKK

SEQ ID NO: 801445 - protein, 84 aa, Homo sapiens
MDRGKFRCRDSLFNPDQVEILDAKTREKLCFLDKVEPHATIAEIKNLFTKTRGRSCGVLGSLHPGNPEKLAQLSSNRNKTRIGK

SEQ ID NO: 801446 - protein, 121 aa, Homo sapiens
MHDVIFHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHSSPAPGIKPACPSRKKK

SEQ ID NO: 801447 - protein, 308 aa, Homo sapiens [sequence omitted]

SEQ ID NO: 801448 - protein, 70 aa, Homo sapiens
MKHYEVEILDAKTREKLCFLDKVEPHATIAEIKNLFTKTHPQWYPARQSLRLDPKGKSREGSLMSVEWGH

SEQ ID NO: 801449 - protein, 308 aa, Homo sapiens [sequence omitted]

SEQ ID NO: 801450 - protein, 308 aa, Homo sapiens [sequence omitted]

SEQ ID NO: 801451 - protein, 320 aa, Homo sapiens
MDRGKFRCRDSLFNPDQVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801452 - protein, 327 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLGMQNPSVEVTCESAHRGRERGQVRRKRA

SEQ ID NO: 801453 - protein, 317 aa, Homo sapiens
PEDVLGFATHSPLQEEPSGRIEREKLCLLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801454 - protein, 340 aa, Homo sapiens
MKHYEVEILDAKTREKLCFLDKVEPHATIAEIKNLFTKTHPQWYPARQSLRLDPSEYSCPLGPPPGLLGGSGRRPGYPLSPGRLSAEGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801455 - protein, 338 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPSKWPQTILPSPTVPTQRVLPSWAPLPASSSAYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801456 - protein, 262 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEWPCSPWWASPR

SEQ ID NO: 801457 - protein, 299 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVHLACICHSFHYIKRLLETLFVHRFSHGTMPLRNIFKNCTYYWGFAAWMAYYINHPLYTPPNLPARQLLHPHGPAGPAARWVQDAEDPIPHQEPLHVALPAGVLPQLHLRGGVLDRFRHHDAVSPSGPVLPGGLHPDDHLGQGQAPQLPEGVPGLPAPAHAHHPLPALSAHPC

SEQ ID NO: 801458 - protein, 363 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDFTSSRHTVVQYVGQVGGGKGKAEDLPDQPQLSLLPPTSLACICHSFHYIKRLLETLFVHRFSHGTMPLRNIFKNCTYYWGFAAWMAYYINHPLYTPPTYGAQQVKLALAIFVICQLGNFSIHMALRDLRPAGRVPVLGAGGQLGWVRGSDFLLLSCLPGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 801459 - protein, 123 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFIYLLFSCIQERDEMISFTGEGAL

SEQ ID NO: 801460 - protein, 336 aa, Homo sapiens
MKLGAREAGIGSQTPAEAKVTVRASPSLGSKYSIHVWTHGSLDRRVSHTFSAAWTGPPRLSRPLALARYPCRATDRSGVLDELFGKKWQKRCEGETDEEEQSAKNKISKLVEEVKYFSKFHTPLVKLPESHFPLLLQRLLSLYGNSFTSSFIPFLLSSEPLKTQLYPLCTTETECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 801461 - protein, 229 aa, Homo sapiens
EDEGKMSRKIEGFLLLLLFGYEATLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 801462 - protein, 124 aa, Homo sapiens
WTHGSLDRRVSHTFSAAWTGPPRLSRPLALARYPCRATDRSGVLDELFGKKWQKRCEGETDEEEQSAKNKVTGRGGTGFFPSPLPTLSELVALSGAAAAGGGGKQKGGSVIKCSKWRGLRDTQG

SEQ ID NO: 801463 - protein, 644 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801464 - protein, 660 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801465 - protein, 651 aa, Homo sapiens [sequence omitted]

SEQ ID NO: 801466 - protein, 631 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801467 - protein, 548 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGVPTAVQNLAPRAAVAAAAPRAVAPYKYASSVRSPHPAIQPLQVRFTRQNA

SEQ ID NO: 801468 - protein, 615 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801469 - protein, 642 aa, Homo sapiens
MNAAASSYPMASLYVGDLHSDVTEAMLYENRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801470 - protein, 550 aa, Homo sapiens
RYEALGVTFSALETNCSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801471 - protein, 667 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKNAGRSGNVRHTGVLDLFLHVIHSSLEASYTLEMQVQLTMTWTALVGIRERIVLLQHHGAPRGNGKKRRGSTVYTNPTYNGTELASDNGGALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801472 - protein, 500 aa, Homo sapiens
DAVVLPGDSVVSVEPGLLREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801473 - protein, 644 aa, Homo sapiens; identical to SEQ ID NO: 801463

SEQ ID NO: 801474 - protein, 648 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAARFKSQITPYGIQLKV

SEQ ID NO: 801475 - protein, 648 aa, Homo sapiens; identical to SEQ ID NO: 801474

SEQ ID NO: 801476 - protein, 587 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERIVPTHPKQSQGIL

SEQ ID NO: 801477 - protein, 490 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGEQTGL

SEQ ID NO: 801478 - protein, 339 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVLYCDLGIESSGIPL

SEQ ID NO: 801479 - protein, 272 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKVSIPQRLGKAFKRLPQSMGRVLLAPT

SEQ ID NO: 801480 - protein, 162 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKLVCYENRSKGIAFVHTRTQGVADRHSDSRWILL

SEQ ID NO: 801481 - protein, 660 aa, Homo sapiens; identical to SEQ ID NO: 801464

SEQ ID NO: 801482 - protein, 644 aa, Homo sapiens; identical to SEQ ID NO: 801463

SEQ ID NO: 801483 - protein, 644 aa, Homo sapiens; identical to SEQ ID NO: 801463

SEQ ID NO: 801484 - protein, 490 aa, Homo sapiens; identical to SEQ ID NO: 801477

SEQ ID NO: 801485 - protein, 533 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGGIGCTQKGERWDLTGLCPD

SEQ ID NO: 801486 - protein, 517 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGGIGCTQKGERWDLTGLCPD

SEQ ID NO: 801487 - protein, 706 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVLSVPVRSNNHRMSQPWPHLAINWHTQGGYWFSAQVWPAPTSPLQGRFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 801488 - protein, 660 aa, Homo sapiens; identical to SEQ ID NO: 801464

SEQ ID NO: 801489 - protein, 660 aa, Homo sapiens; identical to SEQ ID NO: 801464

SEQ ID NO: 801490 - protein, 644 aa, Homo sapiens; identical to SEQ ID NO: 801463

SEQ ID NO: 801491 - protein, 644 aa, Homo sapiens; identical to SEQ ID NO: 801463

SEQ ID NO: 801492 - protein, 646 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQHHESHSTGSSRS

SEQ ID NO: 801493 - protein, 483 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQVQRMPRIYASRGPSILATGPTGKVGSLAPITLAGRCGRG

SEQ ID NO: 801494 - protein, 290 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKLKFLILGISHL

SEQ ID NO: 801495 - protein, 168 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKV

SEQ ID NO: 801496 - protein, 338 aa, Homo sapiens
MELWGRMLWALLSGPGRRGSTRGWAFSSWQPQPPLAGLSSAIELVSHWTGVFEKRGIPEARESSEYIVAHVLGAKTFQSLRPALWTQPLTSQQLQCIRELSSRRLQRMPVQYILGEWDFQGLSLRMVPPVFIPRPETEELVEWVLEEVAQRSHAVGSPGSPLILEVGCGSGAISLSLLSQLPQSRVIAVDKREAAISLTHENAQRLRLQDRIWIIHLDMTSERSWTHLPWGPMDLIVSNPPYVFHQDMEQLAPEIRSYEDPAALDGGEEGMDIITHILALAPRLLKDSGSIFLEVDPRHPELVSSWLQSRPDLYLNLVAVRRDFCGRPRFLHIRRSGP

SEQ ID NO: 801497 - protein, 1084 aa, Homo sapiens
MECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPGLKCVLLCPMESSSEEVGEDNCGKSPGGPSQGPISALSRLSSEQRAPLLTRFENCWLEVRTPLTSGDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLAEDSDLISSSGPSALDKPPELDLGLSKQLYPCSGRLNSDPPKWQCLNHLNLNMVTILPSHSKMDFADVIKDLEMEGVSWIFQVTEYNHKGLCKGGRSVRVTEENVCNNGSRGQSDAIAGGRAMSRGMQTASSPLGPQEECSPANTLILSPVKLIQIADLQNSKIINLCCFHMCENTCVIICYSSHGKRIYIVVPKLECCCNTRLLIEVALELQRGNGQRLEEFLRVMINCLNHLSSDEVMWPGELFLNLQTYTAQAPPFFTHIWREVALSQSEKTERLTSMGPRREWVRNGTGMWGESARLASMAHLQRLGPERTSETGTKPVPALLWSYVTGPGPLGCVRMAGALYSLGCRYCICEMSTAAPDFELMGLAPPCEAIGLSRAVSPFCSYGGVGLSLGFSTSWFLKLNWPTGALSPVPVQAGTRTSLSRGTKGLWRHHPTQPRLGAPEASPNPGATWRATGRPDMGLMLGFRAEKLGDREHGHLGSRVSLAPNHLDTLWMKPGGPVYTGRGGSWQDLYSIPDLFSQRGMGLT

SEQ ID NO: 801498 - protein, 1314 aa, Homo sapiens
MAGGHLVEVTLQLPVPQCPALCPAPAAWTLSCPWLPLRRLLQKEPGWGGRRGCTTRARLPTSLVPHAHRPLPAKVLTSIALSVFLLVPFGSCCLQQHLRVAALTSEQSVAPLTSASPGFPDGLSLLASGPFLRKGLGELVDVAPEESAVLESDTVGAAGATSRSRPRAQLSAQKNVQLDSAEEKVQAKRTGRRGLKPAATGLIGPWTLSPDVGATPAWISIPESAPHQDVTLEQMTSPHSALASKAEKWDLMLFYFKDACEEPMECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPGLKCVLLCPMESSSEEVGEDNCGKSPGGPSQGPISALSRLSSEQKGSTADKFENCWLEVRTPLTLRDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLAEDSDLISSSGPSALDKPPELDLGLSKQLYPCSGRLNSDPPKWQCLNHLNLNMVTILPSHSKMDFADVIKDLEMEGVSWIFQETEYNHKGLCKGGRSVRVTEENVCNNGSRGQSDAIAGGRAMSRGMQTASSPLGPQEECSPANTLILSPVKLISDADLQNSKIINLCCFHMCENTCVIICYSSHGKRIYIVVPKLECCCNTRLLIEVALELQRGNGQRLEEFLRVMINCLNHLSSDEVMWPGELFLNLQTYTAQAPPFFTHIWREVALSQSEKTERLTSMGPRREWVRNGTGMWGESARLASMAHLQRLGPERTSETGTKPVPALLWSYVTGPGPLGCVRMAGALYSLGCRYCICEMSTAAPDFELMGLAPPCKPWPEQSCVTILFLWWSGAIPGVLNLLVPKTELAKLVPSALSLSKLGLGPPFPGVLKDSGDTIPPSQGLGLLKPVLTQEPHGELLGGQTWASCWVSELRSWGTESMDTWVQGSAWPQITWIRFG

SEQ ID NO: 801499 - protein, 1314 aa, Homo sapiens
MAGGHLVEVTLQLPVPQCPALCPAPAAWTLSCPWLPLRRLLQKEPGWGGRRGCTTRARLPTSLVPHAHRPLPAKVLTSIALSVFLLVPFGSCCLQQHLRVAALTSEQSVPPYTSASPGFPDGLSLLASGPFLRKGLGELVDVAPEESAVLESDTVGAAGATSRSRPRAQLSAQKNVQLDSAEEKVQAKRTGRRGLKPAATGLIGPWTLSPDVGATPAWISIPESAPHQDVTLEQMTSPHSALASKAEKWDLMLFYFMDACEEPMECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPGLKCVLLCPMESSSEEVGEDNCGKSPGGPSQGPISALSRLSSEQRAPLLTRFENCWLEVRTPLTLRDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLAEDSDLISSSGPSALDKPPELDLGLSKQLYPCSGRLNSDPPKWQCLNHLNLNMVTILPSHSKMDFADVIKDLEMEGVSWIFQETEYNHKGLCKGGRSVRVTEENVCNNGSRGQSDAIAGGRAMSRGMQTASSPLGPQEECSPANTLILSPVKLISDADLQNSKIINLCCFHMCENTCVIICYSSHGKRIYIVVPKLECCCNTRLLIEVALELQRGNGQRLEEFLRVMINCLNHLSSDEVMWPGELFLNLQTYTAQAPPFFTHIWREVALSQSEKTERLTSMGPRREWVRNGTGMWGESARLASMAHLQRLGPERTSETGTKPVPALLWSYVTGPGPLGCVRMAGALYSLGCRYCICEMSTAAPDFELMGLAPPCKPWPEQSCVTILFLWWSGAIPGVLNLLVPKTELAKLVPSALSLSKLGLGPPFPGVLKDSGDTIPPSQGLGLLKPVLTQEPHGELLGGQTWASCWVSELRSWGTESMDTWVQGSAWPQITWIRFG

SEQ ID NO: 801500 - protein, 1287 aa, Homo sapiens
MSIRQAWRAREGMYCLRSHDSDQVETVSEIPPFGEPILLESYPAYVLPCTMAGGHLVEVTLQLPVPQCPALCPAPAAWTLSCPWLPLRRLLQKEPGWGGRRGCTTRARLPTSLVPHAHRPLPAKVLTSIALSVFLLVPFGSCCLQQHLRVAALTSEQSVPPYTSASPGFPDGLSLLASGPFLRKGLGELVDVAPEESAVLESDTVGAAGATSRSRPRAQLSAQKNVQLDSAEEKVQAKRTGRRGLKPAATGLIGPWTLSPDVGATPAWISIPESAPHQDVTLEQMTSPHSALASKAEKWDLMLFYFKDACEEPMECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPWLKCVLLCPMESSSEEVGEDNCGKSPGGPSQGPISALSRLSSEQRAPLLTRFENCWLEVRTPLTLRDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLAEDSDLISSSWPSALDKPPELDLGLSKQLYPCSGRLNSDPPKWQCLNHLNLNMVTILPSHSKMDFADVIKDLEMEGVSWIFQETEYNHKGLCKGGRSVRVTEENVCNNGSRGQSDAIAGGRAMSRGMQTASSPLGPQEECSPANTLILSPVKLISDADLQNSKIINLCCFHMCENTCVIICYSSHGKRIYIVVPKLECCCNTRLLIEVALELQRGNGQRLEEFLRVMINCLNHLSSDEVMWPGELFLNLQTYTAQAPPFFTHIWREVALSQSEKTERLTSMGPRREWVRNGTGMWGESARLASMAHLQRLGPERTSETGTKPVPALLWSYVTGPGPLGCVRMAGALYSLGCRYCICEMSTAAPDFELMGLAPPCKPWPEQSCVTILFLWWSGAIPGVLNLLVPKTELANWCPQPCPCPSWD

SEQ ID NO: 801501 - protein, 1347 aa, Homo sapiens
MAGGHLVEVTLQLPVPQCPALCPAPAAWTLSCPWLPLRRLLQKEPGWGGRRGCTTRARLPTSLVPHAHRPLPAKVLTSIALSVFLLVPFGSCCLQQHLRVAALTSEQSVPPYTSASPGFPDGLSLLASGPFLRKGLGELVDVAPEESAVLESDTVGAAGATSRSRPRAQLSAQKNVQLDSAEEKVQAKRTGRRGLKPAATGLIGPWTLSPDVGATPAWISIPESAPHQDVTLEQMTSPHSALASKAEKWDLMLFYFKDACEEPMECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPGLKCVLLCPMESSSEEVGEDNCGKSPGGPSQGPISALSRLSSEQKGSTADKFENCWLEVRTPLTLRDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLAEDSDLISSSGPSALDKPPELDLGLSKQLYPCSGRLNSDPPKWQCLNHLNLNMVTILPSHSKMDFADVIKDLEMEGVSWIFQETEYNHKGLCKGGRSVRVTEENVCNNGSRGQSDAIAGGRAMSRGMQTASSPLGPQEECSPANTLILSPVKLISDADLQNSKIINLCCFHMCENTCVIICYSSHGKRIYIVVPKLECCCNTRLLIEVALELQRGNGQRLEEFLRVMINCLNHLSSDEVMWPGELFLNLQTYTAQAPPFFTHIWREVALSQSEKTERLTSMGPRREWVRNGTGMWGESARLASMAHLQRLGPERTSETGTKPVPALLWSYVTGPGPLGCVRMAGALYSLGCRYCICEMSTAAPDFELMGLAPPCEAIGLSRAVSPFCSYGGVGLSLGFSTSWFLKLNWPTGALSPVPVQAGTRTSLSRGTKGLWRHHPTQPRLGAPEASPNPGATWRATGRPDMGLMLGFRAEKLGDREHGHLGSRVSLAPNHLDTLWMKPGGPVYTGRGGSWQDLYSIPDLFSQRGMGLT

SEQ ID NO: 801502 - protein, 327 aa, Homo sapiens [sequence omitted]

SEQ ID NO: 801503 - protein, 306 aa, Homo sapiens [sequence omitted]

SEQ ID NO: 801504 - protein, 1314 aa, Homo sapiens
MAGGHLVEVTLQLPVPQCPALCPAPAAWTLSCPWLPLRRLLQKEPGWGGRRGCTTRARLPTSLVPHAHRPLPAKVLTSIALSVFLLVPFGSCCLQQHLRVAALTSEQSVAPLTSASPGFPDGLSLLASGPFLRKGLGELVDVAPEESAVLESDTVGAAGATSRSRPRAQLSAQKNVQLDSAEEKVQAKRTGRRGLKPAATGLIGPWTLSPDVGATPAWISIPESAPHQDVTLEQMTSPHSALASKAEKWDLMLFYFKDACEEPMECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPGLKCVLLCPMESSSEEVGEDNCGKSPGGPSQGPISALSRLSSEQKGSTADKFENCWLEVRTPLTSGDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLAEDSDLISSSGPSALDKPPELDLGLSKQLYPCSGRLNSDPPKWQCLNHLNLNMVTILPSHSKMDFADVIKDLEMEGVSWIFQETEYNHKGLCKGGRSVRVTEENVCNNGSRGQSDAIAGGRAMSRGMQTASSPLGPQEECSPANTLILSPVKLISDADLQNSKIINLCCFHMCENTCVIICYSSHGKRIYIVVPKLECCCNTRLLIEVALELQRGNGQRLEEFLRVMINCLNHLSSDEVMWPGELFLNLQTYTAQAPPFFTHIWREVALSQSEKTERLTSMGPRREWVRNGTGMWGESARLASMAHLQRLGPERTSETGTKPVPALLWSYVTGPGPLGCVRMSRGPVLSGLQDCICEMSTAAPDFELMGLAPPCKPWPEQSCVTILFLWWSGAIPGVLNLLVPKTELANLVPSALSLSKLGLGPPFPGVLKDSGDTIPPSQGLGLLKPVLTQEPHGELLGGQTWASCWVSELRSWGTESMDTWVQGSAWPQITWIRFG

SEQ ID NO: 801505 - protein, 1314 aa, Homo sapiens
MAGGHLVEVTLQLPVPQCPALCPAPAAWTLSCPWLPLRRLLQKEPGWGGRRGCTTRARLPTSLVPHAHRPLPAKVLTSIALSVFLLVPFGSCCLQQHLRVAALTSEQSVPPYTSASPGFPDGLSLLASGPFLRKGLGELVDVAPEESAVLESDTVGAAGATSRSRPRAQLSAQKNVQLDSAEEKVQAKRTGRRGLKPAATGLIGPWTLSPDVGATPAWISIPESAPHQDVTLEQMTSPHSALASKAEKWDLMLFYFKDACEEPMECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPWLKCVLLCPMESSSEEVGEDNCGKSPGGPSQGPISALSRLSSEQRAPLLTRFENCWLEVRTPLTLRDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLAEDSDLISSSWPSALDKPPELDLGLSKQLYPCSGRLNSDPPKWQCLNHLNLNMVTILPSHSKMDFADVIKDLEMEGVSWIFQETEYNHKGLCKGGRSVRVTEENVCNNGSRGQSDAIAGGRAMSRGMQTASSPLGPQEECSPANTLILSPVKLISDADLQNSKIINLCCFHMCENTCVIICYSSHGKRIYIVVPKLECCCNTRLLIEVALELQRGNGQRLEEFLRVMINCLNHLSSDEVMWPGELFLNLQTYTAQAPPFFTHIWREVALSQSEKTERLTSMGPRREWVRNGTGMWGESARLASMAHLQRLGPERTSETGTKPVPALLWSYVTGPGPLGCVRMAGALYSLGCRYCICEMSTAAPDFELMGLAPPCKPWPEQSCVTILFLWWSGAIPGVLNLLVPKTELAKLVPSALSLSKLGLGPPFPGVLKDSGDTIPPSQGLGLLKPVLTQEPHGELLGGQTWASCWVSELRSWGTESMDTWVQGSAWPQITWIRFG

SEQ ID NO: 801506 - protein, 1352 aa, Homo sapiens
MYCLRSHDSDQVETVKLDPSLWGAYIAGVIPSLSVALHMAGGHLVEVTLQLPVPQCPALCPAPAAWTLSCPWLPLRRLLQKEPGWGGRRGCTTRARLPTSLVPHAHRPLPAKVLTSIALSVFLLVPFGSCCLQQHLRVAALTSEQSVPPYTSASPGFPDGLSLLASGPFLRKGLGELVDVAPEESAVLESDTVGAAGATSRSRPRAQLSAQKNVQLDSAEEKVQAKRTGRRGLKPAATGLIGPWTLSPDVGATPAWISIPESAPHQDVTLEQMTSPHSALASKAEKWDLMLFYFMDACEEPMECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPGLKCVLLCPMESSSEEVGEDNCGKSPGGPSQGPISALSRLSSEQRAPLLTRFENCWLEVRTPLTLRDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLAEDSDLISSSGPSALDKPPELDLGLSKQLYPCSGRLNSDPPKWQCLNHLNLNMVTILPSHSKMDFADVIKDLEMEGVSWIFQETEYNHKGLCKGGRSVRVTEENVCNNGSRGQSDAIAGGRAMSRGMQTASSPLGPQEECSPANTLILSPVKLISDADLQNSKIINLCCFHMCENTCVIICYSSHGKRIYIVVPKLECCCNTRLLIEVALELQRGNGQRLEEFLRVMINCLNHLSSDEVMWPGELFLNLQTYTAQAPPFFTHIWREVALSQSEKTERLTSMGPRREWVRNGTGMWGESARLASMAHLQRLGPERTSETGTKPVPALLWSYVTGPGPLGCVRMAGALYSLGCRYCICEMSTAAPDFELMGLAPPCKPWPEQSCVTILFLWWSGAIPGVLNLLVPKTELAKLVPSALSLSKLGLGPPFPGVLKDSGDTIPPSQGLGLLKPVLTQEPHGELLGGQTWASCWVSELRSWGTESMDTWVQGSAWPQITWIRFG

SEQ ID NO: 801507 - protein, 1050 aa, Homo sapiens
MECAWLGTLWHFSLPSSEGRHREEGPSALRRPSDAWDQHKAGRDTRQSGKKGRQEFQSWALDSSLLSRDGASRLVAWQPTSPLSLSSLWPQCLEAQARAASGSSSGKARPTCPIPSLAPEAKARDSNSLPTTTSICQGALAGRMGGGHGADGVQAVQAPEVLRDVPTARAASFSQSPEHRQECRSPCLMYSGRVILSPLLIVGETEALSHSWMLFPVVSGFLHGSHTAAFIEIGPEPPKCKKYSFLLLYPHLDPGLLAAPNPCPKHLAGSPGLKCVLLCPMESSSEEVGEDNCGKSPGGPSQGPISALSRLSSEQRAPLLTRFENCWLEVRTPLTLRDSMSFPIHLRFFSLFFLHWLLLSGFSSLLPWASAFVQYSRCPEHTPSLCPGGANNPLLQAPTQMLPPLGCLLCALPASPSPYLCWHLLYHAFRNLLIPLISGAPCGSGIPKFSKCAISKLMVHAFSRIELGLPMWPTSDLAAHVFRSLGMGSHEDLAFCPTQAAIQVEQMATSKTQVHLIPAQQPHQENRLSLAAVGAGARFPGALGFSQPPARVLARTVTCSPPHDPSALDKPPELDLGLSKQLYPCSGRLNSDPPKWQCLNHLNLNMVTILPSHSKMDFADVIKDLEMEGVSWIFQVNWYNHKGLCKGGRSVRVTEENVCNNGSRGQSDAIAGGRAMSRGMQTASSPLGPQEECSPANTLILSPVKLISDADLQNSKIINLCCFHMCENTCVIICYSSHGKRIYIVVPKLECCCNTRLLIEVALELQRGNGQRLEEFLRVMINCLNHLSSEGDVARGTLPQPSDLNCPGPPFFYSYLEKVALSQSEKTERLTSMGPRREWVRNGTGMWGESARLASMAHLQRLGPERTSETGTKPVPALLWSYVTGPGPLGCVRMAGALYSLGCRYCICEMSTAAPDFELMGLAPPCKPWPEQSCVTILFLWWSGAIPGVLNLLVPKTELAKLVPSALSLSKLGLGPPFPGVLKDSGDTIPPSQGLGLLKPVLTQEPHGELLGGQTWASCWVSELRSWGTESMDTWVQGSAWPQITWIRFG

SEQ ID NO: 801508 - protein, 359 aa, Homo sapiens
MELWGRMLWALLSGPGRRGSTRGWAFSSWQPQPPLAGLSSAIELVSHWTGVFEKRGIPEARESSEYIVAHVLGAKTFQSLRPALWTQPLTSQQLQCIRELSSRRLQSSVPDDHPAAPSARMPVQYILGEWDFQGLSLRMVPPVFIPRPETEELVEWVLEEVAQRSHAVGSPGSPLILEVGCGSGAISLSLLSQLPQSRVIAVDKREAAISLTHENAQRLRLQDRIWIIHLDMTSERSWTHLPWGPMDLIVSNPPYVFHQDMEQLAPEIRSYEDPAALDGGEEGMDIITHILALAPRLLKDSGSFSYEVTQHRTAEVVQNRLTVLIWVWPDFVEPAWNRGGKMGRVLERTTRGGVNRFVP

SEQ ID NO: 801509 - protein, 388 aa, Homo sapiens
MPCLQSASTWSSYEHNSESYLLREHVSELDSSFHSVLSLPSDVPLHFHFETLLKKTEIKGNLAENKFVDEYIISPSPVHSTLNQWRNGYSPICKPQIRSESSAQLLQGRKKRHLSETALGERTKLEESDFQHTESGSHSNFTAVSNVNVLSRIQNSSRNTARRRLRSESSYDIDNIVIPMSLVAPAKLEKLQYKEILTPSWRMVVLQPLDEYNLGKEEIEDLSDEVFSLRHKKYEEREQARWSLWEQSKWHRRNSRAYSKNVEGQDLLLKEYPNNFSSSQQCAAASPPGLPSENQDLCAYGLPSLNQSQETKSLWWERRAFPLKGEDMAALLCQDEKKDQVERSSTAFHGEIFGTSVPENGHHPKKQSDGMEEYKTFGLGLTNVKKNR

SEQ ID NO: 801510 - protein, 275 aa, Homo sapiens [sequence omitted]

SEQ ID NO: 801511 - protein, 3014 aa, Homo sapiens
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKVQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 801512 - protein, 2379 aa, Homo sapiens
MDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKVQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 801513 - protein, 1402 aa, Homo sapiens
MPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKVQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 801514 - protein, 2990 aa, Homo sapiens
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASPQPVTMPRRPGAATSTSLCVTQMAPVLCIHFMCSPPCLRIFKKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKVQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 801515 - protein, 2996 aa, Homo sapiens
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKITSGESDPNFVSSSQMLTSCSECPTLFVDAETLLSCGLLDKLKFSVLELQEYLDTYNNRKEATLSWLANCKATFAGGSRDGVITCQPGDSEEKVQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 801516 - protein, 195 aa, Homo sapiens
MESLAQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 801517 - protein, 2788 aa, Homo sapiens
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSPFMWTSGQAQVQCVRTARIFGYLQQQERGHTLLACKL

SEQ ID NO: 801518 - protein, 35 aa, Homo sapiens
MAFVEQDKTQLNLIFFHTNVFHLIDAIHHIPFNIA

SEQ ID NO: 801519 - protein, 626 aa, Homo sapiens
MKSQLQFFVAQTTKGRTVSQERTLDSQVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKVQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 801520 - protein, 519 aa, Homo sapiens
MQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKVQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 801521 - protein, 2828 aa, Homo sapiens
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKVIKAC

SEQ ID NO: 801522 - protein, 171 aa, Homo sapiens
QLTLQQGPERIGTDLASRRNSQASGSESQRSIQLGASEPEGGHGKDKDFPLLLTQRPIFRILEPPFHQALPMSIILMTSSAEFNQMLLQPHHLHLLLAVLQHAQLGLLVEQVKQLCQAGGMRLRPLGTRHPTRLLPPTSLPSSDKSQQQERQRIRTDGCQPSRGQYTWDLS

SEQ ID NO: 801523 - protein, 135 aa, Homo sapiens
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGKQGYFHLCVAIHVCCIGTVLPFHFID

SEQ ID NO: 801524 - protein, 135 aa, Homo sapiens; identical to SEQ ID NO: 801523

SEQ ID NO: 801525 - protein, 319 aa, Homo sapiens
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGFRSLGGTRLFRWLYEKFRYPFAPMYGGFPVKLRTYLGDPIPYDPQITAEELAEKTKNAVQALIDKHQRIPGNIMSAC

SEQ ID NO: 801526 - protein, 244 aa, Homo sapiens [sequence omitted]

SEQ ID NO: 801527 - protein, 319 aa, Homo sapiens; identical to SEQ ID NO: 801525

SEQ ID NO: 801528 - protein, 205 aa, Homo sapiens
MEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGFRSLGGTRLFRWLYEKFRYPFAPMYGGFPVKLRTYLGDPIPYDPQITAEELAEKTKNAVQALIDKHQRIPGNIMSAC

SEQ ID NO: 801529 - protein, 135 aa, Homo sapiens; identical to SEQ ID NO: 801523

SEQ ID NO: 801530 - protein, 135 aa, Homo sapiens; identical to SEQ ID NO: 801523

SEQ ID NO: 801531 - protein, 231 aa, Homo sapiens
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVVI

SEQ ID NO: 801532 - protein, 319 aa, Homo sapiens; identical to SEQ ID NO: 801525

SEQ ID NO: 801533 - protein, 73 aa, Homo sapiens
KSRLDCRHRRTLAPGGFSFPSTRSVKTQRLIALAKMAEAKACPTCPRSSEGFSDPRRLRSGIRTRGCPKPRAV

SEQ ID NO: 801534 - protein, 73 aa, Homo sapiens; identical to SEQ ID NO: 801533

SEQ ID NO: 801535 - protein, 815 aa, Homo sapiens
VADGRTRAGGRCGAGRAAGQAAGMLRAALSLLALPLAGAAEEPTQKPESPGEPPPGLELFRWQWHEVEAPYLVALWILVASLAKIAPRVQAGLLDFLLFGSLISAVDPVAVLAVFEEVHVNETLFIIVFGESLLNDAVTVVLYKVCNSFVEMGSANVQATDYLKGVAGRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRDRAEDRALWHATKDFPPDCHGSSIFGYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 801536 - protein, 578 aa, Homo sapiens
GRPTASGTRAPPQVRLIRRAVRMAEPSSWHPSSVSPQLERGLPRRRGRVDPGTPAQDFSGEEHSLQPLPAEHLPPVFMAPTLNPRSPQPFSGLPHLERRSQQAVHRGYLRAQGQRPVQAAGGGPARLRKVGTCEGVGVFQVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVAPRVQAGLLDFLLFGSLISAVDPVAVLAVFEEVHVNETLFIIVFGESLLNDAVTVYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 801537 - protein, 961 aa, Homo sapiens
VADGRTRAGGRCGAGRAAGQAAGMLRAALSLLALPLAGAAEEPTQKPESPGEPPPGLELFRWQWHEVEAPYLVALWILVASLAKIAPRVQAGLLDFLLFGSLISAVDPVAVLAVFEEVHVNETLFIIVFGESLLNDAVTVVLYKVCNSFVEMGSANVQATDYLKGVAGRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGRRKACLPSGTPLGSWRLTASSFEPPSVRIQLRGNPSWDSPQGLDDYSSLGSLLMFLESQKGKVRPSEGEQPLGHVVTCWEAAGPPTKDEKGRRKGDSFEGQLHELLSQPTLMHPDFLLGHGSLLPGWPRDGRTTGTDINSLPCWVRKTCPVDPTRCQGWGGKPGPEAQVFFLGPQKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 801538 - protein, 613 aa, Homo sapiens
GRPTASGTRAPPQVRLIRRAVRMAEPSSWHPSSVSPQLERGLPRRRGRVDPGTPAQDFSGEEHSLQPLPAEHLPPVFMAPTLNPRSPQPFSGLPHLERRSQQAVHRGYLRAQGQRPVQAAGGGPARLRKVGTCEGVGVFQVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVGLTLPSMPSRNSVAETSVTNLLRESGSGACLDLQVIDTVRSGRDREDAVMHHLLCGGLYKPRRRDRAEDRALWHATKDFPPDCHGSSIFGYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 801539 - protein, 525 aa, Homo sapiens
VADGRTRAGGRCGAGRAAGQAAGMLRAALSLLALPLAGAAEEPTQKPESPGEPPPGLELFRWQWHEVEAPYLVALWILVASLAKIAPRVQAGLLDFLLFGSLISAVDPVAVLAVFEEVHVNETLFIIVFGESLLNDAVTVVLYKVCNSFVEMGSANVQATDYLKGVAGRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRDRAEDRALWHATKDFPPD

SEQ ID NO: 801540 - protein, 919 aa, Homo sapiens
VADGRTRAGGRCGAGRAAGQAAGMLRAALSLLALPLAGAAEEPTQKPESPGEPPPGLELFRWQWHEVEAPYLVALWILVASLAKIVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVAPRVQAGLLDFLLFGSLISAVDPVAVLAVFEEVHVNETLFIIVFGESLLNDAVTVVLYKVCNSFVEMGSANVQATDYLKGVASLFVVSLGGAAVGLVFAFLLALTTRFTKRVRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 801541 - protein, 468 aa, Homo sapiens
VADGRTRAGGRCGAGRAAGQAAGMLRAALSLLALPLAGAAEEPTQKPESPGEPPPGLELFRWQWHEVEAPYLVALWILVASLAKIVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVVQSQLQSPLHLRGCAGAQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 801542 - protein, 347 aa, Homo sapiens
MFLESQKGKVRPSEGEQPLGHVVTCWEAAGPPTKDEKGRRKGDSFEGQLHELLSQPTLMHPDFLLGHGSLLPGWPRDGRTTGTDINSLPCWVRKTCPVDPTRCQGWGGKPGPEAQVFFLGPQKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 801543 - protein, 344 aa, Homo sapiens
AGPRPMAAAAAAALESWQAAAPRKRRSAARRPRRREAAPRGREAAPRGREAAPRGPEAEFESDSGVVLRRIWEAEKDLFISDFWSSALETINRCLTKHLEQLKTPVGTLSDIFGNLHLDSLPEESDVATDSIPREILVTGTCHLKCVCYGIGNFATCIVARNQLTFLLLLLEKCQIPRSHCWVYDPLFSQLEIEVLNTLGVTVLSENEEGKRSIRGEPTIFYMLHCGTALYNNLLWSNWSVDALSKMVIIGNSFKGLEERLLARILQKNYPYIAKILKGLEELEFPQTSQYMDIFNDTSVHWFPVQKLEQLSIDIWEFREEPDYQDCEDLEIIRNKREDPSATD

SEQ ID NO: 801544 - protein, 275 aa, Homo sapiens
MAAAAAAALESWQAAAPRKRRSAARRPRRREAAPRGREAAPRGREAAPRGPEAEFESDSGVVLRRIWEAEGTCHLKCVCYGIGNFATCIVARNQLTFLLLLLEKCQIPRSHCWVYDPLFSQLEIEVLNTLGVTVLSENEEGKRSIRGEPTIFYMLHCGTALYNNLLWSNWSVDALSKMVIIGNSFKGLEERLLARILQKNYPYIAKILKGLEELEFPQTSQYMDIFNDTSVHWFPVQKLEQLSIDIWEFREEPDYQDCEDLEIIRNKREDPSATD

SEQ ID NO: 801545 - protein, 337 aa, Homo sapiens
AGPRPMAAAAAAALESWQAAAPRKRRSAARRPRRREAAPRGREAAPRGPEAEFESDSGVVLRRIWEAEKDLFISDFWSSALETINRCLTKHLEQLKTPVGTLSDIFGNLHLDSLPEESDVATDSIPREILVTGTCHLKCVCYGIGNFATCIVARNQLTFLLLLLEKCQIPRSHCWVYDPLFSQLEIEVLNTLGVTVLSENEEGKRSIRGEPTIFYMLHCGTALYNNLLWSNWSVDALSKMVIIGNSFKGLEERLLARILQKNYPYIAKILKGLEELEFPQTSQYMDIFNDTSVHWFPVQKLEQLSIDIWEFREEPDYQDCEDLEIIRNKREDPSATD

SEQ ID NO: 801546 - protein, 241 aa, Homo sapiens
MAAAAAAALESWQAAAPRKRRSAARRPRRREAAPRGREAAPRGPEAEFESDSGVVLRRIWEAEKDLFISDFWSSALETINRCLTKHLEQLKTPVGTLSDIFGNLHLDSLPEESDVATDSIPREILVTGTCHLKCVCYGIGNFATCIVARNQLTFLLLLLEKCQIPRSHCWVYDPLFSQLEIEVLNTLGVTVLSENEVSGLKGSRQNCKNPDQTHPRPCLWTPAFFAVAAIPLLPPAHFCSA

SEQ ID NO: 801547 - protein, 111 aa, Homo sapiens
MVSRQGPSVTTGGGRGDERALSDTLETARRPLPDVGPSILDFPASLQNWKLPRLCPLPLTLLKEDKEDNDKWRLQQSNTNSQLDAQERTLCLFLMVSSALHILRNFSGNKL

SEQ ID NO: 801548 - protein, 66 aa, Homo sapiens
MFYAQKCHCFLADIIMDSIRQKDPKAITAKVVSLANRLWVCVTGLRPWGTLYLLHLFPCPTISGAR

SEQ ID NO: 801549 - protein, 201 aa, Homo sapiens
GTLKDWSKQRTKERESPAPEQPLPEASEVDSLGVILKVTHPPVVGSDGFCMFFEDSIIYTTEMDNLRHTTPTASPQPQEVTFLSFSLSWEEMFYAQKCHCFLADIIMDSIRQKDPKAITAKVVSLANRLWTLHISPKQFVVDLLAITGFKDDRHTQERLYSWVELTLPFARKYGRCMDLLIQRGLSRSVSYSILGKYLQED

SEQ ID NO: 801550 - protein, 150 aa, Homo sapiens
NSSRQSQVQLGSDGEATLLARLTEGCRAQQSLAGLGSQALPRAPWASLPQLRRPLHGAPDGWGLALRSHEHRGPQPRQLPSHQPPRLSLSSRHSRDLAEATDPLPMLIALACIFLLLATCLLFMTLCKPAALDPSRRRAHECMPHHPGSP

SEQ ID NO: 801551 - protein, 153 aa, Homo sapiens
LDSQAGVQWHDLGSLQSPPPGFKQFSCPSLSSSWDYRRPPPHPANFVFLVETGFHHVGQAGLELLTSGDPSTSASQRAGITGVRHRARQKYFKISQRCRFNPNPPSASWSWDKYCLHRAHTHRHPPDTLAWRPRTWGSWAQLCQRPILPLLAV

SEQ ID NO: 801552 - protein, 314 aa, Homo sapiens
MGPLINRCKKILLPTTVPPATMRIWLLGGLLPFLLLLSGLQRPTEGSEVAIKIDFDFAPGSFDDQYQGCSKQVMEKLTQGDYFTKDIEAQKNYFRMWQKAHLAWLNQGKVLPQNMTTTHAVAILFYTLNSNVHSDFTRAMASVARTPQQYERSFHFKYLHYYLTSAIQLLRKDSIMENGTLCYEVHYRTKDVHFNAYTGATIRFGQFLSTSLLKEEAQEFGNQTLFTIFTCLGAPVQYFSLKKEVLIPPYELFKVINMSYHPRGDWLQLRSTGNLSTYNCQLLKASSKKCIPDPIAIASLSFLTSVIIFSKSRV

SEQ ID NO: 801553 - protein, 459 aa, Homo sapiens
MAASASAAAGEEDWVLPSEVEVLESIYLDELQVIKGNGRTSPWEIYITLHPATAEDQDSQYVCFTLVLQVPAEYPHEVPQISIRNPRGLSDEQIHTILQVLGHVAKAGLGTAMLYELIEKGKEILTDNNIPHGQCVICLYGFQEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 801554 - protein, 347 aa, Homo sapiens
MLYELIEKGKEILTDNNIPHGQCVICLYGFQEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 801555 - protein, 404 aa, Homo sapiens [sequence omitted]

SEQ ID NO: 801556 - protein, 388 aa, Homo sapiens
RLGGGWCESAEARNPRGLSDEQIHTILQVLGHVAKAGLGTAMLYELIEKGKEILTDNNIPHGQCVICLYGFQEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 801557 - protein, 355 aa, Homo sapiens
MLYELIEKGKEILTDNNIPHGQCVICLYGFQCPTSAFPLEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 801558 - protein, 306 aa, Homo sapiens
MAASASAAAGEEDWVLPSEVEVLESIYLDELQVIKGNGRTSPWEIYITLHPATAEDQDSQYVCFTLVLQVPAEYPHEVPQISIRNPRGLSDEQIHTILQVLGHVAKAGLGTAMLYELIEKGKEILTDNNIPHGQCVICLYGFQEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTPSRTYTPSTSLPPRGSS

SEQ ID NO: 801559 - protein, 459 aa, Homo sapiens; identical to SEQ ID NO: 801553

SEQ ID NO: 801560 - protein, 347 aa, Homo sapiens; identical to SEQ ID NO: 801554

SEQ ID NO: 801561 - protein, 337 aa, Homo sapiens
MAASASAAAGEEDWVLPSEVEVLESIYLDELQVIKGNGRTSPWEIYITLHPATAEDQDSQYVCFTLVLQVPAEYPHEVPQISIRNPRGLSDEQIHTILQVLGHVAKAGLGTAMLYELIEKGKEILTDNNIPHGQCVICLYGFQEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQSYPLHFLQNP

SEQ ID NO: 801562 - protein, 467 aa, Homo sapiens
MAASASAAAGEEDWVLPSEVEVLESIYLDELQVIKGNGRTSPWEIYITLHPATAEDQDSQYVCFTLVLQVPAEYPHEVPQISIRNPRGLSDEQIHTILQVLGHVAKAGLGTAMLYELIEKGKEILTDNNIPHGQCVICLYGFQCPTSAFPLEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 801563 - protein, 246 aa, Homo sapiens
SLRGLQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 801564 - protein, 118 aa, Homo sapiens
IPRPQEYLMPFFSSCLCPSHYSGPSLPSSTSSSLPTGPENQLGFVLLQAMVHHANSSCVRNAFWLQITEKLTPALSIIISVVYLRCPEMVENRIGFLLNVKDSKTLSVVGPHPKPCIL

SEQ ID NO: 801565 - protein, 118 aa, Homo sapiens; identical to SEQ ID NO: 801564

SEQ ID NO: 801566 - protein, 555 aa, Homo sapiens
MGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKENRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRQSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 801567 - protein, 650 aa, Homo sapiens
MPFATAVDRGLLKPQKVKLDNEGKHYPSLNKELDLGTETGERDLPCLPYPTGRCFLFSQYILTYGYKGVKLSSQTLIQAGDDEKNQRTITVNPAHMGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKENRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRQSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 801568 - protein, 555 aa, Homo sapiens; identical to SEQ ID NO: 801566

SEQ ID NO: 801569 - protein, 189 aa, Homo sapiens
MGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKMESCSVGQG

SEQ ID NO: 801570 - protein, 587 aa, Homo sapiens
MEGESVKLSSQTLIQAGDDEKNQRTITVNPAHMGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKENRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRQSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 801571 - protein, 505 aa, Homo sapiens
MSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKENRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRQSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 801572 - protein, 650 aa, Homo sapiens; identical to SEQ ID NO: 801567

SEQ ID NO: 801573 - protein, 187 aa, Homo sapiens
MGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKIFSFLFF

SEQ ID NO: 801574 - protein, 357 aa, Homo sapiens
TIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLALVCTSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYFGQGRGGGGY

SEQ ID NO: 801575 - protein, 279 aa, Homo sapiens
GWYRPDVWDPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYFGQGRGGGGY

SEQ ID NO: 801576 - protein, 162 aa, Homo sapiens [sequence omitted]

SEQ ID NO: 801577 - protein, 389 aa, Homo sapiens
TIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYFGQGRGGGGY

SEQ ID NO: 801578 - protein, 389 aa, Homo sapiens; identical to SEQ ID NO: 801577

SEQ ID NO: 801579 - protein, 389 aa, Homo sapiens; identical to SEQ ID NO: 801577

SEQ ID NO: 801580 - protein, 389 aa, Homo sapiens; identical to SEQ ID NO: 801577

SEQ ID NO: 801581 - protein, 235 aa, Homo sapiens
LGRGRVVAVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYFGQGRGGGGY

SEQ ID NO: 801582 - protein, 389 aa, Homo sapiens; identical to SEQ ID NO: 801577

SEQ ID NO: 801583 - protein, 389 aa, Homo sapiens; identical to SEQ ID NO: 801577

SEQ ID NO: 801584 - protein, 254 aa, Homo sapiens
GWYRPDVWDPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGIKTWLCQFLCVDSKEKKACYVLRVFSSMFICHQKVNAFSPILWFIVV

SEQ ID NO: 801585 - protein, 153 aa, Homo sapiens
MGGFGSRFWQEGVWDRDLEKSTRLEEDAMESEPLAGTKTRGRGRRRWEARRAWTLPAHASQPSPRTVVATATGAEVSARAGRSAGTRVARPESQLSHLYGWDKYSNPRPSRRARAVARVHALEQAPILCRALRRGLTQFLRGTSPVTQSVPFS

SEQ ID NO: 801586 - protein, 153 aa, Homo sapiens; identical to SEQ ID NO: 801585

SEQ ID NO: 801587 - protein, 153 aa, Homo sapiens; identical to SEQ ID NO: 801585

SEQ ID NO: 801588 - protein, 153 aa, Homo sapiens; identical to SEQ ID NO: 801585

SEQ ID NO: 801589 - protein, 327 aa, Homo sapiens
PRRQELPGRSPSSWSALGWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEVWIHPYPF

SEQ ID NO: 801590 - protein, 269 aa, Homo sapiens
ALVSTQSGSLLARVRSRFISWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKRDEYFAKKLRKEPISGLISSNGAEQPVEKTSVS

SEQ ID NO: 801591 - protein, 383 aa, Homo sapiens
PRRQELPGRSPSSWSALGWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801592 - protein, 385 aa, Homo sapiens
ALVSTQSGSLLARVRSRFISWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801593 - protein, 383 aa, Homo sapiens; identical to SEQ ID NO: 801591

SEQ ID NO: 801594 - protein, 383 aa, Homo sapiens; identical to SEQ ID NO: 801591

SEQ ID NO: 801595 - protein, 383 aa, Homo sapiens; identical to SEQ ID NO: 801591

SEQ ID NO: 801596 - protein, 283 aa, Homo sapiens
MIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801597 - protein, 283 aa, Homo sapiens; identical to SEQ ID NO: 801596

SEQ ID NO: 801598 - protein, 283 aa, Homo sapiens; identical to SEQ ID NO: 801596

SEQ ID NO: 801599 - protein, 296 aa, Homo sapiens
MVIMKRWLPWRPKSVIKLRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801600 - protein, 201 aa, Homo sapiens
PRRQELPGRSPSSWSALGWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKV

SEQ ID NO: 801601 - protein, 201 aa, Homo sapiens; identical to SEQ ID NO: 801600

SEQ ID NO: 801602 - protein, 162 aa, Homo sapiens
LRRSEDPLFVLQRDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801603 - protein, 150 aa, Homo sapiens
MDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801604 - protein, 182 aa, Homo sapiens
MYDYAYMAAGRTEEAITVRKASEMHSGLDVRLEQEYLRYIEHTIDCERYRTDLRLKMTASCVGKDQRLVGLDSACHIAGVVDDELNLNSDSSRISTVDFPHLIGDPEPGIDFVRGAKEGIILFKEKAKEALGKAKDANNGNLQLRNKEVTWEVLEGEVEKRSTEENNRRPTRIPKQMEVKRS

SEQ ID NO: 801605 - protein, 180 aa, Homo sapiens
PRRQELPGRSPSSWSALGWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIVSGPVMHLNILHLFRK

SEQ ID NO: 801606 - protein, 334 aa, Homo sapiens
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801607 - protein, 295 aa, Homo sapiens
PRRQELPGRSPSSWSALGWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDTWQKMRRNNKGVIRVKGKKKKKKFGGAEILNLWGAGECRSDAEGFQNGGVQSCCSGFTG

SEQ ID NO: 801608 - protein, 334 aa, Homo sapiens; identical to SEQ ID NO: 801606

SEQ ID NO: 801609 - protein, 383 aa, Homo sapiens; identical to SEQ ID NO: 801591

SEQ ID NO: 801610 - protein, 383 aa, Homo sapiens; identical to SEQ ID NO: 801591

SEQ ID NO: 801611 - protein, 258 aa, Homo sapiens
PRRQELPGRSPSSWSALGWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQ

SEQ ID NO: 801612 - protein, 283 aa, Homo sapiens; identical to SEQ ID NO: 801596

SEQ ID NO: 801613 - protein, 283 aa, Homo sapiens; identical to SEQ ID NO: 801596

SEQ ID NO: 801614 - protein, 279 aa, Homo sapiens
RGSRGLQRNFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801615 - protein, 267 aa, Homo sapiens
PRRQELPGRSPSSWSALGWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKFR

SEQ ID NO: 801616 - protein, 243 aa, Homo sapiens
RFFAKLNEERKLNKVEAKLRAKQEKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKRSTEENNRRPTRIPKQMEVKRS

SEQ ID NO: 801617 - protein, 267 aa, Homo sapiens
PRRQELPGRSPSSWSALGWPAALGGGVVAVAVCEPVARLLWAGTLKIAAMAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKRDEYFAKKLRKEPISGLISSNGAEQPVEKTSVS

SEQ ID NO: 801618 - protein, 184 aa, Homo sapiens
MIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQSYEEDLNEILGRKIGVLKFG

SEQ ID NO: 801619 - protein, 949 aa, Homo sapiens
ADLKGLGPLGPGMAAAAEPGARAWLGGGSPRPGSPACSPVLGSGGRARPGPGPGPGRDRAGGVRARARAAPGHSFRKVTLTKPTFCHLCSDFIWGLAGFLCDVCNFMSHEKCLKHVRIPCTSVAPSLVRVPVAHCFGPRGLHKRKFCAVCRKVLEAPALHCEVCELHLHPDCVPFACSDCRQCHQDGHQDHDTHHHHWREGNLPSGARCEVCRKTCGSSDVLAGVRCEWCGVQAHSLCSAALAPECGFGRLRSLVLPPACVRLLPGGFSKTQSFRIVEAAEPGEGGDGADGSAAVGPGRETQATPESGKQTLKIFDGDDAVRRSQFRLVTVSRLAGAEEVLEAALRAHHIPEDPGHLELCRLPPSSQACDAWAGGKAGSAVISEEGRSPGSGEATPEAWVIRALPRAQEVLKIYPGWLKVGVAYVSVRVTPKSTARSVVLEVLPLLGRQAESPESFQLVEVAMGCRHVQRTMLMDEQPLLDRLQDIRQMSVRQVSQTRFYVAESRDVAPHVSLFVGGLPPGLSPEEYSSLLHEAGATKATVVSVSHIYSSQGAVVLDVACFAEAERLYMLLKDMAVRGRLLTALVLPDLLHAKLPPDSCPLLVFVNPKSGGLKGRDLLCSFRKLLNPHQVFDLTNGGPLPGLHLFSQVPCFRVLVCGGDGTVGWVLGALEETRYRLACPEPSVAILPLGTGNDLGRVLRWGAGYSGEDPFSVLLSVDEADAVLMDRWTILLDAHEAGSAENDTADAEPPKIVQMSNYCGIGIDAELSLDFHQAREEEPGKFTSRLHNKGVYVRVGLQKISHSRSLHKQIRLQVERQEVELPSIEGLIFINIPSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADACACP

SEQ ID NO: 801620 - protein, 455 aa, Homo sapiens
MRPRGVPGVKWDSPGPHVAPDLSLGQPWAGETSWFGSCPGTVGAMGQAPPESWAPAAGAVVLDVACFAEAERLYMLLKDMAVRGRLLTALVLPDLLHAKLPPDSCPLLVFVNPKSGGLKGRDLLCSFRKLLNPHQVFDLTNGGPLPGLHLFSQVPCFRVLVCGGDGTVGWVLGALEETRYRLACPEPSVAILPLGTGNDLGRVLRWGAGYSGEDPFSVLLSVDEADAVLMDRWTILLDAHEAGSAENDTADAEPPKIVQMSNYCGIGIDAELSLDFHQAREEEPGKFTSRLHNKGVYVRVGLQKISHSRSLHKQIRLQVERQEVELPSIEGLIFINIPSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADACACP

SEQ ID NO: 801621 - protein, 170 aa, Homo sapiens
ADLKGLGPLGPGMAAAAEPGARAWLGGGSPRPGSPACSPVLGSGGRARPGPGPGPGRDRAGGVRARARAAPGHSFRKVTLTKPTFCHLCSDFIWGLAGFLCDVCNFMSHEKCLKHVRIPCTSVAPSLVRVPVAHCFGPRGLHKRKFCAVCRKVLEAPALHCEVCEMFPLL

SEQ ID NO: 801622 - protein, 975 aa, Homo sapiens
ADLKGLGPLGPGMAAAAEPGARAWLGGGSPRPGSPACSPVLGSGGRARPGPGPGPGRDRAGGVRARARAAPGHSFRKVTLTKPTFCHLCSDFIWGLAGFLCDVCNFMSHEKCLKHVRIPCTSVAPSLVRVPVAHCFGPRGLHKRKFCAVCRKVLEAPALHCEVCELHLHPDCVPFACSDCRQCHQDGHQDHDTHHHHWREGNLPSGARCEVCRKTCGSSDVLAGVRCEWCGVQAHSLCSAALAPECGFGRLRSLVLPPACVRLLPGGFSKTQSFRIVEAAEPGEGGDGADGSAAVGPGRETQATPESGKQTLKIFDGDDAVRRSQFRLVTVSRLAGAEEVLEAALRAHHIPEDPGHLELCRLPPSSQACDAWAGGKAGSAVISEEGRSPGSGEATPEAWVIRALPRAQEVLKIYPGWLKVGVAYVSVRVTPKSTARSVVLEVLPLLGRQAESPESFQLVEVAMGCRHVQRTMLMDEQPLLDRLQDIRQGGLELQISPRSSRGTDRGCPQQGSLCGPFPRFPVDLIPGSVPDALFCCFAGEETEGLVRWCRSPRPSIPAPLPADAATVVSVSHIYSSQGAVVLDVACFAEAERLYMLLKDMAVRGRLLTALVLPDLLHAKLPPDSCPLLVFVNPKSGGLKGRDLLCSFRKLLNPHQVFDLTNGGPLPGLHLFSQVPCFRVLVCGGDGTVGWVLGALEETRYRLACPEPSVAILPLGTGNDLGRVLRWGAGYSGEDPFSVLLSVDEADAVLMDRWTILLDAHEAGSAENDTADAEPPKIVQMSNYCGIGIDAELSLDFHQAREEEPGKFTSRLHNKGVYVRVGLQKISHSRSLHKQIRLQVERQEVELPSIEGLIFINIPSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADACACP

SEQ ID NO: 801623 - protein, 56 aa, Homo sapiens
MSPWSSVPCPGTGAHAEEGQAEAEEGRDHQGCPGGCVRLPLRAILGRGGWGSPRAR

SEQ ID NO: 801624 - protein, 140 aa, Homo sapiens
GFFSRRTFCGRSGRSCRGQLVQVSRPEVSAGSLLLPAPQAEDHSSRILYPRPKSLLPKMMNADMDAVDAENQVELEEKTRLINQVLELQHTLEDLSARVDAVKEENLKLKSENQVLGQYIENLMSASSVFQTTDTKSKRK

SEQ ID NO: 801625 - protein, 140 aa, Homo sapiens; identical to SEQ ID NO: 801624

SEQ ID NO: 801626 - protein, 140 aa, Homo sapiens; identical to SEQ ID NO: 801624

SEQ ID NO: 801627 - protein, 140 aa, Homo sapiens; identical to SEQ ID NO: 801624

SEQ ID NO: 801628 - protein, 112 aa, Homo sapiens
GFFSRRTFCGRSGRSCRGQLVQVSRPEVSAGSLLLPAPQAEDHSSRILYPRPKSLLPKMMNADMDDLSARVDAVKEENLKLKSENQVLGQYIENLMSASSVFQTTDTKSKRK

SEQ ID NO: 801629 - protein, 144 aa, Homo sapiens
GFFSRRTFCGRSGRSCRGQLVQVSRPEVSAGSLLLPAPQAEDHSSRILYPRPKSLLPKMMNADMDAVDAENQVELEEKTRLINQVLELQHTLEDLSARVDAVKEENLKLKSENQVLGQYIENLMSASSVFQTTDTKITVPLWLH

SEQ ID NO: 801630 - protein, 122 aa, Homo sapiens
MDGSRKEEEEDSTFTNISLADDIDHSSRILYPRPKSLLPKMMNADMDAVDAENQVELEEKTRLINQVLELQHTLEDLSARVDAVKEENLKLKSENQVLGQYIENLMSASSVFQTTDTKSKRK

SEQ ID NO: 801631 - protein, 140 aa, Homo sapiens; identical to SEQ ID NO: 801624

SEQ ID NO: 801632 - protein, 140 aa, Homo sapiens; identical to SEQ ID NO: 801624

SEQ ID NO: 801633 - protein, 122 aa, Homo sapiens; identical to SEQ ID NO: 801630

SEQ ID NO: 801634 - protein, 606 aa, Homo sapiens
MAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTESPPTPLSKTNKKARKKSLPASQPPVAVAEQVETVLIETTADNIIQAGNNLLIVQSPGGGQPAVVQQVQVVPPKAEQQQVVQIPQQALRVVQAASATLPTVPQKPSQNFQIQAAEPTPTQVYIRTPSGEVQTVLVQDSPPATAAATSNTTCSSPASRAPHLSGTSKKHSAAILRKERPLPKIAPAGSIISLNAAQLAAAAQAMQTININGVQVQGVPVTITNTGGQQQLTVQNVSGNNLTISGLSPTQIQLQMEQALAGETQPGEKRRRMACTCPNCKDGEKRSGEQGKKKHVCHIPDCGKTFRKTSLLRAHVRLHTGERPFVCNWFFCGKRFTRSDELQRHARTHTGDKRFECAQCQKRFMRSDHLTKHYKTHLVTKNL

SEQ ID NO: 801635 - protein, 71 aa, Homo sapiens
SEVSLPVTCSPQVRPRKTRGTRDTLPSPVLNGTSARRVPRSMHWQVAGSPSLSLHLTPARPKLYLCTVYIV

SEQ ID NO: 801636 - protein, 144 aa, Homo sapiens
MTTRIKNQTTTRLSIYTSDEIHLPNTEKKPVIVIRLKALIPDQERQANLGPYCRRSQKSNCRKRVPTIDQYQTGGPESNGPGDTEPKYDCKPSNTQNAMRPKPDPNPEGPKQGTAVNNQGPKTTKIARDPENQRPNTPQTRVKN

SEQ ID NO: 801637 - protein, 606 aa, Homo sapiens; identical to SEQ ID NO: 801634

SEQ ID NO: 801638 - protein, 606 aa, Homo sapiens; identical to SEQ ID NO: 801634

SEQ ID NO: 801639 - protein, 675 aa, Homo sapiens
DKRMRVSQLWSSRSGGAPKAEQQQVVQIPQQALRVVQAASATLPTVTPEASQNFQIQAAEPTPTHPQTSMAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTESPPTPLSKTNKKARKKSLPASQPPVAVAEQVETVLIETTADNIIQAGNNLLIVQSPGGGQPAVVQQVQVVPPKAEQQQVVQIPQQALRVVQAASATLPTVPQKPSQNFQIQAAEPTPTQVYIRTPSGEVQTVLVQDSPPATAAATSNTTCSSPASRAPHLSGTSKKHSAAILRKERPLPKIAPAGSIISLNAAQLAAAAQAMQTININGVQVQGVPVTITNTGGQQQLTVQNVSGNNLTISGLSPTQIQLQMEQALAGETQPGEKRRRMACTCPNCKDGEKRSGEQGKKKHVCHIPDCGKTFRKTSLLRAHVRLHTGERPFVCNWFFCGKRFTRSDELQRHARTHTGDKRFECAQCQKRFMRSDHLTKHYKTHLVTKNL

SEQ ID NO: 801640 - protein, 282 aa, Homo sapiens
IGGCLAGGVRLSVAAEAAEAREEDVVMSDPQTSMAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTASCQTGMLNSTRMFLFLAFINVL

SEQ ID NO: 801641 - protein, 282 aa, Homo sapiens; identical to SEQ ID NO: 801640

SEQ ID NO: 801642 - protein, 65 aa, Homo sapiens
MAATAAVSPSDYLQPAASTTQDSQPSPLALLAATCSKIGPPAVEAAVTPPAPPQPTPRFLKKGRE

SEQ ID NO: 801643 - protein, 632 aa, Homo sapiens
SSWSRSEKYESEAREEDVVMSDPQTSMAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTESPPTPLSKTNKKARKKSLPASQPPVAVAEQVETVLIETTADNIIQAGNNLLIVQSPGGGQPAVVQQVQVVPPKAEQQQVVQIPQQALRVVQAASATLPTVPQKPSQNFQIQAAEPTPTQVYIRTPSGEVQTVLVQDSPPATAAATSNTTCSSPASRAPHLSGTSKKHSAAILRKERPLPKIAPAGSIISLNAAQLAAAAQAMQTININGVQVQGVPVTITNTGGQQQLTVQNVSGNNLTISGLSPTQIQLQMEQALAGETQPGEKRRRMACTCPNCKDGEKRSGEQGKKKHVCHIPDCGKTFRKTSLLRAHVRLHTGERPFVCNWFFCGKRFTRSDELQRHARTHTGDKRFECAQCQKRFMRSDHLTKHYKTHLVTKNL

SEQ ID NO: 801644 - protein, 639 aa, Homo sapiens
IGGCLAGGVRLSVAAEAAEAREEDVVMSDPQTSMAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTESPPTPLSKTNKKARKKSLPASQPPVAVAEQVETVLIETTADNIIQAGNNLLIVQSPGGGQPAVVQQVQVVPPKAEQQQVVQIPQQALRVVQAASATLPTVPQKPSQNFQIQAAEPTPTQVYIRTPSGEVQTVLVQDSPPATAAATSNTTCSSPASRAPHLSGTSKKHSAAILRKERPLPKIAPAGSIISLNAAQLAAAAQAMQTININGVQVQGVPVTITNTGGQQQLTVQNVSGNNLTISGLSPTQIQLQMEQALAGETQPGEKRRRMACTCPNCKDGEKRSGEQGKKKHVCHIPDCGKTFRKTSLLRAHVRLHTGERPFVCNWFFCGKRFTRSDELQRHARTHTGDKRFECAQCQKRFMRSDHLTKHYKTHLVTKNL

SEQ ID NO: 801645 - protein, 342 aa, Homo sapiens
SSWSRSEKYESEAREEDVVMSDPQTSMAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTESPPTPLSKTNKKARKKSLPASQPPVAVAEQVETVLIETTADNIIQAGNNLLIVQSPGGGQPAVVQQVQVVPPKAEQQQVVQIPQQAHEQ

SEQ ID NO: 801646 - protein, 125 aa, Homo sapiens
MAGAGPTMLLREENGCCSRRQSSSSAGDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 801647 - protein, 125 aa, Homo sapiens; identical to SEQ ID NO: 801646

SEQ ID NO: 801648 - protein, 105 aa, Homo sapiens
MLGHLRRREIATLKILQVWPSHQAPARHGSCSVGHWISWLLLCSSARTHYYYDLRRVREPRGERLSADMETIVLFRPPSTEINIRGGVWTARVHGKRSMSPAWGI

SEQ ID NO: 801649 - protein, 132 aa, Homo sapiens
KALMQSLGGISETERPTWETKKSLKEPNLTFWTMDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 801650 - protein, 115 aa, Homo sapiens
MAGAGPTMLLREENGCCSRRQSSSSAGDSDGEREDSAAERARQQLEALLNKTMRIRMTDGREQVGGTSGLTGTPWTPRARQTPSDDTPRREPRCKARAGTRHQRSPEAEATRPHR

SEQ ID NO: 801651 - protein, 125 aa, Homo sapiens; identical to SEQ ID NO: 801646

SEQ ID NO: 801652 - protein, 152 aa, Homo sapiens
RPPTTTKFAAARRVLRKLKGPEEASGQMAGAGPTMLLREENGCCSRRQSSSSAGDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 801653 - protein, 125 aa, Homo sapiens; identical to SEQ ID NO: 801646

SEQ ID NO: 801654 - protein, 125 aa, Homo sapiens; identical to SEQ ID NO: 801646

SEQ ID NO: 801655 - protein, 131 aa, Homo sapiens [sequence omitted]

SEQ ID NO: 801656 - protein, 117 aa, Homo sapiens
MKQLRYRERERSWNCEKAEDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 801657 - protein, 135 aa, Homo sapiens
MAGAGPTMLLREENGCCSRRQSSSSAGDSDGEREDSAAERARQQLEALLNKTMRIRMTDGRTLVGCFLCTDRDCNVILGSAQEFLKPSGQCPGNAHPPDSFSAGEPRVLGLAMVPGHHIVSIEVQRESLTGPPYL

SEQ ID NO: 801658 - protein, 117 aa, Homo sapiens
MWPRCGHPPATAASASPRKDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 801659 - protein, 70 aa, Homo sapiens
GNSCAEPRMTLQSRSVQEFLKPSGQCPGNAHPPDSFSAGEPRVLGLAMVPGHHIVSIEVQRESLTGPPYL

SEQ ID NO: 801660 - protein, 125 aa, Homo sapiens; identical to SEQ ID NO: 801646

SEQ ID NO: 801661 - protein, 125 aa, Homo sapiens; identical to SEQ ID NO: 801646

SEQ ID NO: 801662 - protein, 190 aa, Homo sapiens
MRVSRKEAESGAPRREGRASPRPELDRGPLQPCAREDDRTQGGRQDPGGRGSQEKRGAAPGRGLGPSALSRLTPLFHPQTRIVLILPLDKRQPLANAGQRIDYASGAGLGSPAAPRLRGAGEGSEREPRMPVLLLLRRQEARRPEEGGARAALSWPRLLSRFRSPGKAPREAGPAEEQPRKRCRCPRPQL

SEQ ID NO: 801663 - protein, 175 aa, Homo sapiens
ARAQGAEQTECGPSSPVVTSPAMGNYSSHKRTKAPKQARKERPADMDKAWWKSFLNHLTRKKPATRIVLILPLDKRQPLANAGQRIDYASGAGLGSPAAPRLRGAGEGSEREPRMPVLLLLRRQEARRPEEGGARAALSWPRLLSRFRSPGKAPREAGPAEEQPRKRCRCPRPQL

SEQ ID NO: 801664 - protein, 91 aa, Homo sapiens
LGCEERHERSEEGAVGSSQQVSELKPVDLGALGSLAGCGVRMEWAGKQRDFQVRAAPGWDHLASFPGPSLRLFSGSQASVCSLCSGFGAQE

SEQ ID NO: 801665 - protein, 266 aa, Homo sapiens
LDPAVNPVPKPKRTFEYEADKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRKAGRKSQQLSENSLDSLHRMWSPQDRKYNSPPTQLSLKPNSQSLRSGNWSERKSHRLPRLPKRHSHDDMLLLAQLSLPSSTSKPQWKTSLSNNKRCCPNRRARPQSQSLSKRNLNSHPTNGQRRRESKLKKRLSQG

SEQ ID NO: 801666 - protein, 171 aa, Homo sapiens
MTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDAQKESVQGAAQDVAGVAACLPLAQSTPFPGPAAGPRGVLLTRTGTRAHSLGIPEKISAWEG

SEQ ID NO: 801667 - protein, 1135 aa, Homo sapiens
MTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDTQKESVQGAAQDVAGVAACLPLAQSTPFPGPAAGPRGVLLTRTGTRSPQPGHPGEDIAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEAEKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801668 - protein, 609 aa, Homo sapiens
MWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801669 - protein, 443 aa, Homo sapiens
YTTLYHPDTTNIYLLSTYCVPGAGGVVEEALDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801670 - protein, 201 aa, Homo sapiens
MIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801671 - protein, 342 aa, Homo sapiens
MEARRTGIKVCSPGAGVEQGHRRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801672 - protein, 232 aa, Homo sapiens
MSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801673 - protein, 886 aa, Homo sapiens
MTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDTQKESVQGAAQDVAGVAACLPLAQSTPFPGPAAGPRGVLLTRTGTRSPQPGHPGEDIAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEAEKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEYPLQLLPRGGGLALPLLLAAHLHSCPPGLHD

SEQ ID NO: 801674 - protein, 1135 aa, Homo sapiens; identical to SEQ ID NO: 801667

SEQ ID NO: 801675 - protein, 672 aa, Homo sapiens
MTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDTQKESVQGAAQDVAGVAACLPLAQSTPFPGPAAGPRGVLLTRTGTRSPQPGHPGEDIAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEAEKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSCYVQEDLLKKSSFYFLLVVRIPIPSVFERQRPISPHL

SEQ ID NO: 801676 - protein, 54 aa, Homo sapiens
SRVDERPGKEQVGRGKQLQLLRGGPEGSTHLAGPGPLSHRSPAGVRAAAAHGLK

SEQ ID NO: 801677 - protein, 171 aa, Homo sapiens; identical to SEQ ID NO: 801666

SEQ ID NO: 801678 - protein, 171 aa, Homo sapiens; identical to SEQ ID NO: 801666

SEQ ID NO: 801679 - protein, 156 aa, Homo sapiens
DPDNSWSDGEEVRAVQFGGQLLLPAAPGPRLPHPCPPPSLAHSRRGFLAASGASERSPPPGSSSPPSLSWVEAHILHAPSTQICAPSPLSPCSPAAARGADACPPPALSAGAAPPPGRAAPGETPSRRRARPGWGTQRKMRDCLGATTSTMSPCTG

SEQ ID NO: 801680 - protein, 715 aa, Homo sapiens
MTANKNSSITHGAGGTKAPRGTLSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRDENSESESDSDDRFKAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801681 - protein, 1120 aa, Homo sapiens
MTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDTQKESVQGAAQDVAGVAACLPLAQSTPFPGPAAGPRGVLLTRTGTRSPQPGHPGEDIAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEAEKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKLVQRINSIYNAKRGKKRLKKLSMSSIETASLRAHTQRLVHIQSMLKRAPSYRTLELELLEWQERELFEYFVVVSLKKKPSRNTYLPEVSYQFPKLDRPTKQMREAEERLKAIPQFCFPDAKDWLPVSEYSSETFSFMLTGEDGSRRFGYCRRLLPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801682 - protein, 368 aa, Homo sapiens
MKTVRARATLMTGSKPSGKGPRLPEVYCVISRLGCFGLFSKVLDEVERRRGISAALVYPFMRSLMESPFPAPGKTIKVKTFLPGAGNEVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801683 - protein, 293 aa, Homo sapiens
LHSRVDERPGKEQVLELRRPMDSRLEHVDFECLFTCLSVRQLIRIFASLLLERRVIFVADKLSTLSSCSHAVVALLYPFSWQHTFIPVLPASMIDIVCCPTPFLVGLLSSSLPKLKELPVEEALMVNLGSDRFIRQMDDEDTLLPRKLQAALEQALERKNELISQDSDSDSDDECNTLNGLVSEVFIRFFVETVGHYSLFLTQSEKGERAFQREAFRKSVASKSIRRFLEVFMESQMFAGFIQDRELRKCRAKGLFEQRVEQYLEELPDTEQSGMNKFLRGLGNKMKFLHKKN

SEQ ID NO: 801684 - protein, 75 aa, Homo sapiens
GCLEDPFGSCSDVFMESQMFAGFIQDRELRKCRAKGLFEQRVEQYLEELPDTEQSGMNKFLRGLGNKMKFLHKKN

SEQ ID NO: 801685 - protein, 111 aa, Homo sapiens
KIVGSLIVIRRERAGDWSGYDTWMKFRWVLVTGQFCAADCLSQTTDLPWRPSACLPACLRSPLPVPGPGEQMLSCYVQEDLLKKSSFYFLLVVRIPIPSVFERQRPISPHL

SEQ ID NO: 801686 - protein, 654 aa, Homo sapiens
MTANKNSSITHGAGGTKAPRGTLSRSQSVSPPPVLSPPRSPIYPLSDSETSACRYPSHSSSRVLLKDRHPPAPSPQNPQDPSPDTSPPTCPFKTASFGYLDRSPSACKRDTQKESVQGAAQDVAGVAACLPLAQSTPFPGPAAGPRGVLLTRTGTRSPQPGHPGEDIAWEGRREASPRMSMCGEKREGSGSEWAASEGCPSLGCPSVVPSPCSSEKTFDFKGLRRMSRTFSECSYPETEEEGEALPVRDSFYRLEKRLGRSEPSAFLRGHGSRKESSAVLSRIQKIEQVLKEQPGRGLPQLPSSCYSVDRGKRKTGTLGSLEEPAGGASVSAGSRAVGVAGVAGEAGPPPEREGSGSTKPGTPGNSPSSQRLPSKSSLDPAVNPVPKPKRTFEYEAEKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQLSLKPNSQSLRSGNWSERKSHRLPRLPKRHSHDDMLLLAQLSLPSSPSSLNEDSLSTTSELLSSRRARRIPKVPSPEAAHWSRAGGRAGSQPFSLFPGFLPSLIWTASSIPFE

SEQ ID NO: 801687 - protein, 97 aa, Homo sapiens
LGVLWAHQALVKKSSPTAGMSWVQQFQEAPPVYQPWSLSANKAPDCPALVPWPGLTLVAPKRAWTMRFLFLKVLPSNSGLSFLFATLPPPRPAPVGL

SEQ ID NO: 801688 - protein, 165 aa, Homo sapiens
MAPEENSGSELLLQSFKRRFLAARALRSFPWQSLEAKLRDSSDSELLRDILQKHEAVHTEPLDELYEVLAETLMAKESTQGHRSYLLTCCIAQKPSCRWSGSCGGWLPAGSTSGLLNSTWPLPSATQRCASCSPPSYAGLGSDGKRKLIMTRNCFPTESTWRWQS

SEQ ID NO: 801689 - protein, 125 aa, Homo sapiens
MAPEENSGSELLLQSFKRRFLAARALRSFPWQSLEAKLRDSSDSELLRDILQKTCCIAQKPSCRWSGSCGGWLPAGSTSGLLNSTWPLPSATQRCASCSPPSYVSPHAHPGLHGPQAVPTGLQWK

SEQ ID NO: 801690 - protein, 160 aa, Homo sapiens
MAPEENSGSELLLQSFKRRFLAARALRSFPWQSLEAKLRDSSDSELLRDILQKTVKHPVCVKHPPSVKYARCFLSELIKKPSGGSVTLSKSTAIISHGITVLVTWDAALYLAEWAIENPAAFTDRTVLELGSGAGLTGLAICKMCHPRAYIFRDCHSWVL

SEQ ID NO: 801691 - protein, 131 aa, Homo sapiens
MAPEENSGSELLLQSFKRRFLAARALRSFPWQSLEAKLRDSSDSELLRDILQKTCCIAQKPSCRWSGSCGGWLPAGSTSGLLNSTWPLPSATQRCASCSPPSYAGLGSDGKRKLIMTRNCFPTESTWRWQS

SEQ ID NO: 801692 - protein, 72 aa, Homo sapiens
MPRLPTDLDVEGPWFRHYDFRQSCWVRAISQEDQLAPCWQAEHPAERVRSAFAAPSTDSDQGTPFRARDEQQ

SEQ ID NO: 801693 - protein, 273 aa, Homo sapiens
QDKKDLCGQCSPLGCLIRILIDGISLGLTLRLWDVYLVEGEQALMPITRIAFKVQQKRLTKTSRCGPWARFCNRFVDTWARDEDTVLKHLRASMKKLTRKQGDLQPPAKPEQGSSASRPVPASRGGKTLCKGDRQAPPGPPARFPRPIWSASPPRAPRSSTPCPGGAVREDTYPVGTQGVPSPALAQGGPQGSWRFLQWNSMPRLPTDLDVEGPWFRHYDFRQSCWVRAISQEDQLAPCWQAEHPAERVRSAFAAPSTDSDQGTPFRARDEQQ

SEQ ID NO: 801694 - protein, 168 aa, Homo sapiens
LGAVSQAQQPWDEGVWQEAPSQSEPWGQSQEPPAMPRQLPHARQHAPLPLGSADYRRVLGVRPRGPHRDPEDSEMQAGGAQPGKACVGSLEMLTASVFLSAKPEQGSSASRPVPASRGGKTLCKGDRQAPPGPPARFPRPIWSASPPRAPRSSTPCPGGAVREDTYPV

SEQ ID NO: 801695 - protein, 556 aa, Homo sapiens
MAREKEMQEFTRSFFRGRPDLSTLTHSIVRRRYLAHSGRSHLEPEEKQALKRLVEEELLKMQVDEAASREDKLDLTKKGKRPPTPCSDPERKRFRFNSESESGSEASSPDYFGPPAKNGVAAEVSPAKEENPRRASKAVEESSDEERQRDLPAQRGEESSEEEEKGYKGKTRKKPVVKKQAPGKASVSRKQAREESEESEAEPVQRTAKKVEGNKGTKSLKESEQESEEEILAQKKEQREEEVEEEEKEEDEEKGDWKPRTRSNGRRKSAREERSCKQKSQAKRLLGDSDSEEEQKEAASSGDDSGRDREPPVQRKSEDRTQLKGGKRLSGSSEDEEDSGKGEPTAKGSRKMARLGSTSGEESDLEREVSDSEAGGGPQGERKNRSSKKSSRKGRTRSSSSSSDGSPEAKGGKAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 801696 - protein, 556 aa, Homo sapiens; identical to SEQ ID NO: 801695

SEQ ID NO: 801697 - protein, 252 aa, Homo sapiens
MQEFTRSFFRGRPDLSTLTHSIVRRRYLAHSGRSHLEPEEKQALKRLVEEELLKMQVDEAASREDKLDLTKKGKRPPTPCSDPERKRFRFNSESESGSEASSPDYFGPPAKNGVAAEVSPAKEENPRRASKAVEESSDEERQRDLPAQRGEESSEEEEKGYKGKTRKKPVVKKQAPGKASVSRKQAREESEESEAEPVQRTAKKVEGNKGTKSLKESEQESEEEILAQKKEQREEEVEEEEKEALRMKGTLP

SEQ ID NO: 801698 - protein, 544 aa, Homo sapiens
MAREKEMQEFTRSFFRGRPDLSTLTHSIVRRRYLAHSGRSHLEPEEKQALKRLVEEELLKMQVDEAASREDKLDLTKKGKRPPTPCSDPERKRFRFNSESESGSEASSPDYFGPPAKNGVAAEVSPAKEENPRRASKAVEESSDEERQRDLPAQRGEESSEEEEKGYKGKTRKKPVVKKQAPGKASVSRKQAREESEESEAEPVQRTAKKVEGNKGTKSLKESEQESEEEILAQKKEQREEEVEEEEKEEDEEKGDWKPRTRSNGRRKSAREERSCKQKSQAKRLLGDSDSEEEQKEAASSGDDSGRDREPPVQRKSEDRTQLKGGKRLSGSSEDEEDSGKGEPTAKGSRKMARLGSTSGEESDLEREVSDSEAGGGPQGERKNRSSKNSSDGSPEAKGGKAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 801699 - protein, 380 aa, Homo sapiens
MAREKEMQEFTRSFFRGRPDLSTLTHSIVRRRYLAHSGRSHLEPEEKQALKRLVEEELLKMQVDEAASREDKLDLTKKGKRPPTPCSDPERKRFRFNSESESGSEASSPDYFGPPAKNGVAAEVSPAKEENPRRASKAVEESSDEERQRDLPAQRGEESSEEEEKGYKGKTRKKPVVKKQAPGKASVSRKQAREESEESEAEPVQRTAKKVEGNKGTKSLKESEQESEEEILAQKKEQREEEVEEEEKEEDEEKGDWKPRTRSNGRRKSAREERSCKQKSQELQERQDTKLLFLLRWKSRGQRREGWLRSPWRGPPGCDEAEALHSGLWCPSKLQEAVGLLLLTQGAPEYPPGRTGSARHEGYPFPREVSGPEGAEGGGS

SEQ ID NO: 801700 - protein, 556 aa, Homo sapiens; identical to SEQ ID NO: 801695

SEQ ID NO: 801701 - protein, 551 aa, Homo sapiens
VHARETIIPEELTETSDTLTHSIVRRRYLAHSGRSHLEPEEKQALKRLVEEELLKMQVDEAASREDKLDLTKKGKRPPTPCSDPERKRFRFNSESESGSEASSPDYFGPPAKNGVAAEVSPAKEENPRRASKAVEESSDEERQRDLPAQRGEESSEEEEKGYKGKTRKKPVVKKQAPGKASVSRKQAREESEESEAEPVQRTAKKVEGNKGTKSLKESEQESEEEILAQKKEQREEEVEEEEKEEDEEKGDWKPRTRSNGRRKSAREERSCKQKSQAKRLLGDSDSEEEQKEAASSGDDSGRDREPPVQRKSEDRTQLKGGKRLSGSSEDEEDSGKGEPTAKGSRKMARLGSTSGEESDLEREVSDSEAGGGPQGERKNRSSKKSSRKGRTRSSSSSSDGSPEAKGGKAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 801702 - protein, 456 aa, Homo sapiens
MAREKEMQEFTRSFFRGRPDLSTLTHSIVRRRYLAHSGRSHLEPEEKQALKRLVEEELLKMQEEKGYKGKTRKKPVVKKQAPGKASVSRKQAREESEESEAEPVQRTAKKVEGNKGTKSLKESEQESEEEILAQKKEQREEEVEEEEKEEDEEKGDWKPRTRSNGRRKSAREERSCKQKSQAKRLLGDSDSEEEQKEAASSGDDSGRDREPPVQRKSEDRTQLKGGKRLSGSSEDEEDSGKGEPTAKGSRKMARLGSTSGEESDLEREVSDSEAGGGPQGERKNRSSKKSSRKGRTRSSSSSSDGSPEAKGGKAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 801703 - protein, 202 aa, Homo sapiens
AGWGAVSAALVHSLPSWRTHRWMKPLPGKTNWTLPRRARGLPPLVATRREKGSASIQSRAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 801704 - protein, 69 aa, Homo sapiens
LQQNKRPGDNIISGSGRPRRRTAWNPLGEAAPPGELYRRTLDSDEERPRPAPPDWSHMRGIISSDGESN

SEQ ID NO: 801705 - protein, 556 aa, Homo sapiens; identical to SEQ ID NO: 801695

SEQ ID NO: 801706 - protein, 550 aa, Homo sapiens [sequence omitted]

SEQ ID NO: 801707 - protein, 180 aa, Homo sapiens [sequence omitted]

SEQ ID NO: 801708 - protein, 111 aa, Homo sapiens
GRGGPRWQKLQERLLAYSGAPPLRGGASSTFLFLEPGLLRALRGEDASRGGLGPTPPRKGGSFTSDPLATPGPVWESSPAALLGNAEAACRFLSQFCGPRLGRISSHQHPY

SEQ ID NO: 801709 - protein, 127 aa, Homo sapiens
MRRERDLGRTGEKHNRERRRRLSLTGCVRSRRERVAPEAEGPRELQPGSGFVSGARRLAVFSQVKLILKPFLGVLKTSNKSFCRAKTLFTFPYHILEVANLVTTHQEGDHLQARNRALTVELNWLLP

SEQ ID NO: 801710 - protein, 629 aa, Homo sapiens
MAISPRSDATFSSQKSTPSESPRTKKFPLTEEEIFYMNCRAAYLTVFKSSLENIISKDQLYLALQHAGRNPSQKTINKYWTPQTAKLNFDDFCIILRKEKPTSKAELLKSFKQLDVNDDGCILHTDLYKFLTKRGEKMTREEVNAIINLADVNADGKFDYIKFCKLYMTTNEQCLKTTLEKLEVDSKLMRHQFGNHIEGSPERDPSPVPKPSPKITRKTDPETFLNKGDTRSSLLSATRKFKTSVSFTVTMGANGNRNSKLMEPNLIKDWQHMQSKGCFFLEEDGEIISHQYRMQIAQRSMVYLTIKPLNLSQVEGKPSPWLSVDTALYILKENESQANLQLVCFTELRNREVFGWTGELGPGIYWLIPSTTGCRLRKKIKPVTDEAQLVYRDETGELFLTKEFKSTLSDIFEVIDLDGNGLLSLEEYNFFELRTSGEKCDEDAWAVCRENFDTKRNELTRQGFMDLNLMEANDREGDPCDLWVTLHSMGYNKALELTEACPFVIDIYAEKCKPKIKAVHMEACSGQLEKAICKSVLSNGDAKVMDGYENIIVHTYSCDTWITSVIENKSDEKVIIHISNELSKNCINNRGLNIFAVEVGPKSTMVCQHVMPLNERQEWIYYCIYSLIS

SEQ ID NO: 801711 - protein, 288 aa, Homo sapiens
MIVLFHCFEKKVFGWTGELGPGIYWLIPSTTGCRLRKKIKPVTDEAQLVYRDETGELFLTKEFKSTLSDIFEVIDLDGNGLLSLEEYNFFELRTSGEKCDEDAWAVCRENFDTKRNELTRQGFMDLNLMEANDREGDPCDLWVTLHSMGYNKALELTEACPFVIDIYAEKCKPKIKAVHMEACSGQLEKAICKSVLSNGDAKVMDGYENIIVHTYSCDTWITSVIENKSDEKVIIHISNELSKNCINNRGLNIFAVEVGPKSTMVCQHVMPLNERQEWIYYCIYSLIS

SEQ ID NO: 801712 - protein, 358 aa, Homo sapiens
MAISPRSDATFSSQKSTPSESPRTKKFPLTEEEIFYMNCRAAYLTVFKSSLENIISKDQLYLALQHAGRNPSQKTINKYWTPQTAKLNFDDFCIILRKEKPTSKAELLKSFKQLDVNDDGCILHTDLYKFLTKRGEKMTREEVNAIINLADVNADGKFDYIKFCKLYMTTNEQCLKTTLEKLEVDSKLMRHQFGNHIEGSPERDPSPVPKPSPKITRKTDPETFLNKGDTRSSLLSATRKFKTSVSFTVTMGANGNRNSKLMEPNLIKDWQHMQSKGCFFLEEDGEIISHQYRMQIAQRSMVYLTIKPLNLSQVEGKPSPWLSVDTALYILKENESQANLQLVCFTELRNREVYIFIF

SEQ ID NO: 801713 - protein, 606 aa, Homo sapiens
MAISPRSDATFSSQKSTPSESPRTKKFPLTEEEIFYMNCRAAYLTVFKSSLENIISKDQLYLALQHAGRNPSQKTINKYWTPQTAKLNFDDFCIILRKEKPTSKAELLKSFKQLDVNDDGCILHTDLYKFLTKRGEKMTREEVNAIINLADVNADGKFDYIKFCKLYMTTNEQCLKTTLEKLEVDSKLMRHQFGNHIEGSPERDPSPVPKPSPKITRKTDPETFLNKGDTRSSLLSATRKFKTSVSFTVTMGANGNRNSKLMEPNLIKDWQHMQSKGCFFLEEDGEIISHQYRMQIAQRSMVYLTIKPLNLSQVEGKPSPWLSVDTALYILKENESQANLQLVCFTELRNREVFGWTGELGPGIYWLIPSTTGCRLRKKIKPVTDEAQLVYRDETGELFLTKEFKSTLSDIFEVIDLDGNGLLSLEEYNFFELRTSGEKCDEDAWAVCRENFDTKRNELTRQGFMDLNLMEANDREGDPCDLWVTLHSMGYNKALELTEACPFVIDIYAEKCKPKIKAVHMEACSGQLEKAICKSVLSNGDAKVMDGYENIIVHTYSCDTWITSVIENKSDEKVIIHISNELSKNCINNRGLNIFAVEVGPKSTMP

SEQ ID NO: 801714 - protein, 269 aa, Homo sapiens [sequence omitted]

SEQ ID NO: 801715 - protein, 71 aa, Homo sapiens
GADLKIEYRLPSYYACAEVTVHLEFLDSSGCRPSVGDHISHKASGARFRKTSDAASSWGVVRRFPGWYLYC

SEQ ID NO: 801716 - protein, 371 aa, Homo sapiens
GPRASDRVPGHTGGGCGRRAEMQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALGEPAAAAAALLGGEEI

SEQ ID NO: 801717 - protein, 276 aa, Homo sapiens
MCPEILGMLCLCSRWFRKFYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALGEPAAAAAALLGGEEI

SEQ ID NO: 801718 - protein, 210 aa, Homo sapiens
ARLAGSLGYRRCRTPPRSRTRGPPTAPLPHLHPQPGGLPAGASRSSPARSATRSSRGGGCGRRAEMQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKKSWPALPPFYSVQSHQRTKVFLFLFFHM

SEQ ID NO: 801719 - protein, 179 aa, Homo sapiens
RQTKASGDGLNARLGAGIFPEDFTGQRLAWKDQGGGCGRRAEMQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKEECKYDIPHFQKRNPLLLQN

SEQ ID NO: 801720 - protein, 383 aa, Homo sapiens
WSGSRVIGRADAKGRGLTCAWSTPGGGCGRRAEMQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALGEPAAAAAALLGGEEI

SEQ ID NO: 801721 - protein, 371 aa, Homo sapiens; identical to SEQ ID NO: 801716

SEQ ID NO: 801722 - protein, 124 aa, Homo sapiens
SFQRQLSHLWETKKAEGATSASSTATSAPVKPGPALSYPQEEATLNEMFREVEELMEDTQHKLRSAVEEMEAEEAAAKASSEVNLANLPPSYHNETNTDTKVGNNTIHVHREIHKAALLGGEEI

SEQ ID NO: 801723 - protein, 371 aa, Homo sapiens; identical to SEQ ID NO: 801716

SEQ ID NO: 801724 - protein, 371 aa, Homo sapiens; identical to SEQ ID NO: 801716

SEQ ID NO: 801725 - protein, 371 aa, Homo sapiens; identical to SEQ ID NO: 801716

SEQ ID NO: 801726 - protein, 350 aa, Homo sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALGEPAAAAAALLGGEEI

SEQ ID NO: 801727 - protein, 298 aa, Homo sapiens
ARLAGSLGYRRCRTPPRSRTRGPPTAPLPHLHPQPGGLPAGASRSSPARSATRSSRGGGCGRRAEMQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGEWPPLRCR

SEQ ID NO: 801728 - protein, 415 aa, Homo sapiens
ARLAGSLGYRRCRTPPRSRTRGPPTAPLPHLHPQPGGLPAGASRSSPARSATRSSRGGGCGRRAEMQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALGEPAAAAAALLGGEEI

SEQ ID NO: 801729 - protein, 279 aa, Homo sapiens
MEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALGEPAAAAAALLGGEEI

SEQ ID NO: 801730 - protein, 171 aa, Homo sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHSASSTRTVGPALSYPQRRPPSRCSAS

SEQ ID NO: 801731 - protein, 371 aa, Homo sapiens; identical to SEQ ID NO: 801716

SEQ ID NO: 801732 - protein, 71 aa, Homo sapiens
AIHRHLAIHRHLAIHRRLRDCKLLAQVTQLVKTRAVSSGCDSKLSALSTTPHQPWCHQKCSPKGRRMGFFF

SEQ ID NO: 801733 - protein, 103 aa, Homo sapiens
MAEAITYADLRYPGADDDGEITYENVQVPAVLGVPSSLASSVLGDKAAVKSEQPTASWRAVTSPAVGRILPCRTTCLRYLLLGLLLTCLLLGVTAICLGVRCE

SEQ ID NO: 801734 - protein, 120 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCECACAGQPRGQVLAPVPAADGAGPRGVQLLPG

SEQ ID NO: 801735 - protein, 119 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRCE

SEQ ID NO: 801736 - protein, 307 aa, Homo sapiens
MAEAITYADLRSVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 801737 - protein, 359 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 801738 - protein, 359 aa, Homo sapiens; identical to SEQ ID NO: 801737

SEQ ID NO: 801739 - protein, 104 aa, Homo sapiens
MAEAITYADLRYPGADDDGEITYENVQVPAVLGVPSSLASSVLGDKAAVKSEQPTASWRAVTSPAVGRILPCECACAGQPRGQVLAPVPAADGAGPRGVQLLPG

SEQ ID NO: 801740 - protein, 343 aa, Homo sapiens
MAEAITYADLRYPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 801741 - protein, 314 aa, Homo sapiens
EDVMTEESGAELLRHGEHHYADLERQSDSTASESVTSQLSAFRRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 801742 - protein, 359 aa, Homo sapiens; identical to SEQ ID NO: 801737

SEQ ID NO: 801743 - protein, 190 aa, Homo sapiens [sequence omitted]

SEQ ID NO: 801744 - protein, 495 aa, Homo sapiens
TQQDGKGSAWGPAPLGASRGVGKNEELRLYHHLFNNYDPGSRPVREPEDTVTISLKVTLTNLISLNEKEETLTTSVWIGIDWQDYRLNYSKDDFGGIETLRVPSELVWLPEIVLENNIDGQFGVAYDANVLVYEGGSVTWLPPAIYRSVCAVEVTYFPFDWQNCSLIFRSQTYNAEEVEFTFAVDNDGKTINKIDIDTEAYTENGEWAIDFCPGVIRRHHGGATDGPGETDVIYSLIIRRKPLFYVINIIVPCVLISGLVLLAYFLPAQAGGQKCTVSINVLLAQTVFLFLIAQKIPETSLSVPLLGRFLIFVMVVATLIVMNCVIVLNVSQRTPTTHAMSPRLRHVLLELLPRLLGSPPPPEAPRAASPPRRASSVGLLLRAEELILKKPRSELVFEGQRHRQGTWTAAFCQSLGAAAPEVRCCVDAVNFVAESTRDQEATGEEVSDWVRMGNALDNICFWAALVLFSVGSSLIFLGAYFNRVPDLPYAPCIQP

SEQ ID NO: 801745 - protein, 413 aa, Homo sapiens
MDYRLNYSKDDFGGIETLRVPSELVWLPEIVLENNIDGQFGVAYDANVLVYEGGSVTWLPPAIYRSVCAVEVTYFPFDWQNCSLIFRSQTYNAEEVEFTFAVDNDGKTINKIDIDTEAYTENGEWAIDFCPGVIRRHHGGATDGPGETDVIYSLIIRRKPLFYVINIIVPCVLISGLVLLAYFLPAQAGGQKCTVSINVLLAQTVFLFLIAQKIPETSLSVPLLGRFLIFVMVVATLIVMNCVIVLNVSQRTPTTHAMSPRLRHVLLELLPRLLGSPPPPEAPRAASPPRRASSVGLLLRAEELILKKPRSELVFEGQRHRQGTWTAAFCQSLGAAAPEVRCCVDAVNFVAESTRDQEATGEEVSDWVRMGNALDNICFWAALVLFSVGSSLIFLGAYFNRVPDLPYAPCIQP

SEQ ID NO: 801746 - protein, 117 aa, Homo sapiens
VWLPEIVLENKCEPGQTPGWREAGLGCGLDLVGEGGTLRGCRPVQKARFPRAHSIDGQFGVAYDANVLVYEGGSVTWLPPAIYRSVCAVEVTYFPFDWQNCSLIFRWEELLRGPDDY

SEQ ID NO: 801747 - protein, 424 aa, Homo sapiens
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSGLESTVCVTNVRSFTSAFLFSIEVQVTIGFGGRMMTEECPLAITVLILQNIVGLIINAVMLGCIFMKTAQAHRRAETLIFSRHAVIAVRNGKLCFMFRVGDLRKSMIISASVRIQVVKKTTTPEGEVVPIHQLDIPVDNPIESNNIFLVAPLIICHVIDKRSPLYDISATDLANQDLEVIVILEGVVETTGITTQARTSYIAEEIQWGHRFVSIVTEEEGVYSVDYSKFGNTVKVAAPRCSARELDEKPSILIQTLQKSELSHQNSLRKRNSMRRNNSMRRNNSIRRNNSSLMVPKVQFMTPEGNQNTSES

SEQ ID NO: 801748 - protein, 311 aa, Homo sapiens
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSGLESTVCVTNVRSFTSAFLFSIEVQVTIGFGGRMMTEECPLAITVLILQNIVGLIINAVMLGCIFMKTAQAHRRAETLIFSRHAVIAVRNGKLCFMFRVGDLRKSMIISASVRIQVVKKTTTPEGEVVPIHQLDIPVDNPIESNNIFLVAPLIICHVIDKRSPLYDISATDLANQDLEVVKKTTTPEGEVFHHQLTFL

SEQ ID NO: 801749 - protein, 102 aa, Homo sapiens
MAVSIVTEEEGVYSVDYSKFGNTVKVAAPRCSARELDEKPSILIQTLQKSELSHQNSLRKRNSMRRNNSMRRNNSIRRNNSSLMVPKVQFMTPEGNQNTSES

SEQ ID NO: 801750 - protein, 424 aa, Homo sapiens; identical to SEQ ID NO: 801747

SEQ ID NO: 801751 - protein, 112 aa, Homo sapiens
LARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSGLESTVCVTNVR

SEQ ID NO: 801752 - protein, 115 aa, Homo sapiens
AASPPRAGPRPAHCAAASAVSPPAPHAATGSPAPDAAPAPAASASLILQPPGGSTMPRSPVQPAQVLLDLPPEHPELVPFLHRHSHPLIPSTSSHLNSSSGFLTTHWRVIPSSTH

SEQ ID NO: 801753 - protein, 91 aa, Homo sapiens
CCFSSSSWATACSLRCSFCCVPASSSRSHWFSCTRRRTCARSFCFSDSTAPRWLDNAKITCATSPASAATASRLLLPASGLALAHRTLLDG

SEQ ID NO: 801754 - protein, 118 aa, Homo sapiens
MFPTLYNGSNQPYSCVPALRRGPSPQPWPVLTGEGYCTCPNHTDEKAETQGQQPGSQRSARHTPTLQHQWRWPPLCAEMAATRAQVKSIRALPPTGAFPGLWFLSPPAAPTPSRPLPV

SEQ ID NO: 801755 - protein, 120 aa, Homo sapiens
MRKLRLRASNPGPSGAPGTRRHFSTSGGGHHCARRWLRRVRRSRSQTPSCQNLDPNPPIARFLLPLERISEVPRRACLHGRDASSGNLCTEITQGICHMKMKAEFYKPRDAKDCQQTTRS

SEQ ID NO: 801756 - protein, 120 aa, Homo sapiens; identical to SEQ ID NO: 801755

SEQ ID NO: 801757 - protein, 94 aa, Homo sapiens
MRKLRLRASNPGPSGAPGTRRHFSTSGGGHHCARRWLRRVRRSRSQTPSCQNLDPNPPIARFLLPLERISEVPRRACLHGRDASSVWPPPERSD

SEQ ID NO: 801758 - protein, 220 aa, Homo sapiens
MASQRHLSSEPLSRKKLYLSILISLQISLIITFTATELIIFYIFFETTLIPTLAIITLMRQPARTPERRHILPILHPSRLPSPTHRTNLHSQHPRLTKHSTTHSHCPRTIKLQKKKKKKTRTSSPRAEFGTSGTRLKAETTSRKLQGKEKAWNLILHFREQGWWSLWPFSLNLSEISESFNPKTTVIPQLSTEDWFQDSHGSQNPRMLRIPYIKWHGICI

SEQ ID NO: 801759 - protein, 241 aa, Homo sapiens
GVEKKKKKKKKKKKKNKKVNGLPPEIAAVPELAKYWAQRYRLFSRFDDGIKLDREGWFSVTPEKIAEHIAGRVSQSFKCDVVVDAFCGVGGNTIQFALTGMRVIAIDIDPVKIALARNNAEVYGIADKIEFICGDFLLLASFLKADVVFLSPPWGGPDYATAETFDIRTMMSPDGFEIFRLSKKITNNIVYFLPRNADIDQVASLAGPGGQVEIEQNFLNNKLKTITAYFGDLIRRPASET

SEQ ID NO: 801760 - protein, 493 aa, Homo sapiens
MIFIGFANSRKVVKPRGKSYCNISASLDSQKSSGANTSKDRPHASGTDGDESEEDPPEHKPSKLKRSHELDIDENPASDFDDSGSLLGFKYGSGQKYGGIPNFSHRQVRYLEKNVKLKSKYLDMRRQIKMKNKHIFFTKESEKPFFKKSKILSKVEKFLTWVNKPMDEEASQESSSHDNVHDASTSSDSEEQDMSVKKGDDLLETNNPEPEKCQSVSSAGELETENYERDSLLATVPDEQDCVTQEVPDSRQAETEAEVKKKKNKKKNKKVNGLPPEIAAVPELAKYWAQRYRLFSRFDDGIKLDREGWFSVTPEKIAEHIAGRVSQSFKCDVVVDAFCGVGGNTIQFALTGMRVIAIDIDPVKIALARNNAEVYGIADKIEFICGDFLLLASFLKADVVFLSPPWGGPDYATAETFDIRTMMSPDGFEIFRLSKKITNNIVYFLPRNADIDQVASLAGPGGQVEIEQNFLNNKLKTITAYFGDLIRRPASET

SEQ ID NO: 801761 - protein, 724 aa, Homo sapiens
MCCEKWSRVAEMFLFTEEREDCKILCLCSRAFVEDRKLYNLGLKGYYIRDSGNNSGDQATEEEEGGYSCGTAESHDSKGIGLDESELDSEAELMRSMGLPLQFGRITAHKDFEVSMNTRNKVKIKKKKHQKKYLDEIVQESWRKEYEEDDILASDDPSSIEQYENTRTYELQSKKDTETENPPVENTLSPKLEITEKWEKYWNEYGGGLLWQSWQEKHPGQALSSEPWNFPDTKEEWEQHYSQLYWYYLEQFQYWEAQGWTFDASQSCDTDTYTSKTEADDKNDEKCMKVDLVSFPSSPIMVDNDSSGTSDKDHSEILDGISNIKLNSEEVTQSQLDSCTSHDGHQQLSEVSSKRECPASGQSEPRNGGTNEESNSSGNTNTDPPAEDSQKSSGANTSKDRPHASGTDGDESEEDPPEHKPSKLKRSHELDIDENPASDFDDSGSLLGFKYGSGQKYGGIPNFSHRQVRYLEKNVKLKSKYLDMRRQIKMKNKHIFFTKESEKPFFKKSKILSKVEKFLTWVNKPMDEEASQESSSHDNVHDASTSSDSEEQDMSVKKGDDLLETNNPEPEKCQSVSSAGELETENYERDSLLATVPDEQDCVTQEVPDSRQAETEAEVKKKKNKKKNKKVNGLPPEIAAVPELAKYWAQRYRLFSRFDDGIKLDREGWFSVTPEKIAEHIAGRVSQSFKCDVVVDAFCGVGGNTIQFALTGMREMLILTRWHP

SEQ ID NO: 801762 - protein, 853 aa, Homo sapiens [sequence omitted]

SEQ ID NO: 801763 - protein, 806 aa, Homo sapiens
IRGRVDYGRDQATEEEEGGYSCGTAESHDSKGIGLDESELDSEAELMRSMGLPLQFGRITAHKDFEVSMNTRNKVKIKKKKHQKKYLDEIVQESWRKEYEEDDILASDDPSSIEQYENTRTYELQSKKDTETENPPVENTLSPKLEITEKWEKYWNEYGGGLLWQSWQEKHPGQALSSEPWNFPDTKEEWEQHYSQLYWYYLEQFQYWEAQGWTFDASQSCDTDTYTSKTEADDKNDEKCMKVDLVSFPSSPIMVDNDSSGTSDKDHSEILDGISNIKLNSEEVTQSQLDSCTSHDGHQQLSEVSSKRECPASGQSEPRNGGTNEESNSSGNTNTDPPAEDSQKSSGANTSKDRPHASGTDGDESEEDPPEHKPSKLKRSHELDIDENPASDFDDSGSLLGFKYGSGQKYGGIPNFSHRQVRYLEKNVKLKSKYLDMRRQIKMKNKHIFFTKESEKPFFKKSKILSKVEKFLTWVNKPMDEEASQESSSHDNVHDASTSSDSEEQDMSVKKGDDLLETNNPEPEKCQSVSSAGELETENYERDSLLATVPDEQDCVTQEVPDSRQAETEAEVKKKKNKKKNKKVNGLPPEIAAVPELAKYWAQRYRLFSRFDDGIKLDREGWFSVTPEKIAEHIAGRVSQSFKCDVVVDAFCGVGGNTIQFALTGMRVIAIDIDPVKIALARNNAEVYGIADKIEFICGDFLLLASFLKADVVFLSPPWGGPDYATAETFDIRTMMSPDGFEIFRLSKKITNNIVYFLPRNADIDQVASLAGPGGQVEIEQNFLNNKLKTITAYFGDLIRRPASET

SEQ ID NO: 801764 - protein, 73 aa, Homo sapiens
LSPHPGLAGEACFKSPVTERRPGRRDPGCVRQSCLRSGKMCCEKWSRVAEMFLFTEEREDCKILCLCSRAFVE

SEQ ID NO: 801765 - protein, 151 aa, Homo sapiens
AAAALSRARVWGRLYPQPKLQEAAPLPRRGWDGGGHVGGGGDARGPRLEGESLPHPRLAPAAPSASPALAHPLVAHPARLDSSRNPGTGIYFGGSAAWRPGLSRVSQDRSPNSSRPLSLSGIPADVSPPAKTREEKREPALWSREKVWGVG

SEQ ID NO: 801766 - protein, 216 aa, Homo sapiens
AAAALSRARVWGRLYPQPKLQEAAPLPRRGWDGGGHVGGGGDARGPRLEGESLPHPRLAPAAPSASPALAHPLVAHPARLDSSRNPGTGIYFGGSAAWRPGLSRVSQDRSPNSSRPLSLSGIPADVSPPAKTREEKREPALWSREKEEGATALQDHGWEKEWRGFRTFSVRLHVPVFISGSQALGSWARITCCPPLWSRGCFCKESSGRESMACLT

SEQ ID NO: 801767 - protein, 272 aa, Homo sapiens
AAAALSRARVWGRLYPQPKLQEAAPLPRRGWDGGGHVGGGGDARGPRLEGESLPHPRLAPAAPSASPALAHPLVAHPARLDSSRNPGTGIYFGGSAAWRPGLSRVSQDRSPNSSRPLSLSGLEGSASCSPRRGEEGGGWELQRPLDAAASKGLSWVVGEGAPGAEPRSSGFLILSLGIPADVSPPAKTREEKREPALWSREKEEGATALQDHGWEKEWRGFRTFSVRLHVPVFISGSQALGSWARITCCPPLWSRGCFCKESSGRESMACLT

SEQ ID NO: 801768 - protein, 244 aa, Homo sapiens
YTGSTGSVAFVGLAKLRFLGIARFSSLLTLRMAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSARRKSCLVNGGGTMRQWEGRARNRID

SEQ ID NO: 801769 - protein, 723 aa, Homo sapiens [sequence omitted]

SEQ ID NO: 801770 - protein, 712 aa, Homo sapiens [sequence omitted]

SEQ ID NO: 801771 - protein, 639 aa, Homo sapiens
MIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 801772 - protein, 461 aa, Homo sapiens
RTRGSTHELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 801773 - protein, 473 aa, Homo sapiens
VGDTSGYYQRMLVVLLQANRDPDAGIDEAQVEQDAQAVIYEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 801774 - protein, 658 aa, Homo sapiens
MDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQTGC

SEQ ID NO: 801775 - protein, 152 aa, Homo sapiens
QNKAHTPFRESKLTQVLRDSFIGENSRTCMVSRVTLKVMVQEETELLSTETLSPVPGLEAQHCWLPGFPGCTVTGLPDPALMHETPCGLTKRGGKDLFPLRCVGAALGLGEVIPALPDEKGVPEFGRWAFGSAGEGSPCLFHGLPQVHWLPA

SEQ ID NO: 801776 - protein, 244 aa, Homo sapiens
MDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSARRKSCLVNGGGPLRTAREKMPEPEWIERPRVDGVPRIALLDSAWVPLRLGPFCYPYMP

SEQ ID NO: 801777 - protein, 671 aa, Homo sapiens
MIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 801778 - protein, 682 aa, Homo sapiens
MDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPLRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 801779 - protein, 536 aa, Homo sapiens
MGTKSSAPFLCSGVSNGGCRGPSVRSWPLTGPDMGLEGVGVLDKLAFEIALTLCCWLPPLIRLQIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 801780 - protein, 664 aa, Homo sapiens
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNGSWGGGQSDMGHSFSVPQLSPSREEGALSYPFVLPFFPSRGMFSA

SEQ ID NO: 801781 - protein, 109 aa, Homo sapiens
MHHVHTHTEAYVTHMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 801782 - protein, 113 aa, Homo sapiens
MRPSKTEVWPAEAAPGSHNCLSFWPSQLSKEEEELSSQMSSFNEAMTQIRELEEKAMEELKEIIQRQLALDRELDAARPSVCSTPFPEHDLGLVPTGIHIARSSPLHQHSLIL

SEQ ID NO: 801783 - protein, 209 aa, Homo sapiens
MKGTPSSLDTLMWIYHFHSSTEVALQPPLLSSLELSVAAAHEYLEQRFRELKSLEPPEPKMQGMLPAPKPTLGLVLREATASLVSFGTTLLEVGYWGAWIRGDRVAGTRTSASPLTPVPPMQISALWLQQEARRLDGSAGPAPDGRDPGAALSRVAQAAGQGVRQAGAAVGASARLLVQGAWLCLCGRGLQGSASFLRQSQQQLGLGIP

SEQ ID NO: 801784 - protein, 80 aa, Homo sapiens
RKSLRHGRGGRRDRAPNVASGSSAPRTQELPEARADPQTTPSSAPRGPASSCNLKVTNSPHAKVPIGRRAVGVLLSDGFV

SEQ ID NO: 801785 - protein, 80 aa, Homo sapiens; identical to SEQ ID NO: 801784

SEQ ID NO: 801786 - protein, 186 aa, Homo sapiens
MKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 801787 - protein, 101 aa, Homo sapiens
LDLGHGSFARESSSVYLHTTLLQETEVRDLPRLSSTTLPEAPPSSLALPKAQVSRVARAVVVVLRHVVPEVKTDPPQTWRRPAREDVIRFCSGLDCSLDEV

SEQ ID NO: 801788 - protein, 171 aa, Homo sapiens
MKHMLAASAGEVVACLIRVPSEVVKQRAQVSASTRTFQIFSNILYEEGIQGLYRGYKSTVLREALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 801789 - protein, 101 aa, Homo sapiens; identical to SEQ ID NO: 801787

SEQ ID NO: 801790 - protein, 122 aa, Homo sapiens
MGVLKSPLVLEAGSCGGFLAVSSLWSFCRWICRCSHHPSRRGKDKNYAGKDYLQVSSLEWQPSVWEVSSFWGLMTERTACCWKLAERVLEAETSLTSTSVKRGACSANPLPLSSCLNYRPQC

SEQ ID NO: 801791 - protein, 298 aa, Homo sapiens
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGDHIPGIFLQEQSSGLPLQRVGRQLPGLRASQLAVPPPHPDAELDHLCDCSFCVPLAVLISAI

SEQ ID NO: 801792 - protein, 186 aa, Homo sapiens; identical to SEQ ID NO: 801786

SEQ ID NO: 801793 - protein, 274 aa, Homo sapiens
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 801794 - protein, 259 aa, Homo sapiens
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 801795 - protein, 176 aa, Homo sapiens
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKVDLPLQSPPL

SEQ ID NO: 801796 - protein, 186 aa, Homo sapiens; identical to SEQ ID NO: 801786

SEQ ID NO: 801797 - protein, 186 aa, Homo sapiens; identical to SEQ ID NO: 801786

SEQ ID NO: 801798 - protein, 406 aa, Homo sapiens
MVPPPPSRGGAARGQLGRSLGPLLLLLALGHTWTYREEPEDGDREICSESKIATTKYPCLKSSGELTTCYRKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 801799 - protein, 169 aa, Homo sapiens
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQLSVLPCSRGPGPSGLQGDGAGLPAHLGPLSCICLPSLLCDLGERQCPLWAVRSTQCLIAGKKVLQRLCP

SEQ ID NO: 801800 - protein, 153 aa, Homo sapiens
NSARATPNLKLPPGEREKPLPRRCQPATQPMANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQPPTLPRTAGCWLVHRSCHRDTSL

SEQ ID NO: 801801 - protein, 107 aa, Homo sapiens
TLDDRLIVALDRPEAITAIIVVFSLLAALLLAVGLALLVRKLREKRQTEGTYRPSSEEQPACHRPPTSSCRRKSGSSERWGLLQPPTLPRTAGCWLVHRSCHRDTSL

SEQ ID NO: 801802 - protein, 248 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILFFSYLCLQKAGFQVENRVFVGKN

SEQ ID NO: 801803 - protein, 264 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILITTNMMSSQNTANESSNALKRKREDDDDDDDDDDDYDNL

SEQ ID NO: 801804 - protein, 264 aa, Homo sapiens; identical to SEQ ID NO: 801803

SEQ ID NO: 801805 - protein, 264 aa, Homo sapiens; identical to SEQ ID NO: 801803

SEQ ID NO: 801806 - protein, 264 aa, Homo sapiens; identical to SEQ ID NO: 801803

SEQ ID NO: 801807 - protein, 264 aa, Homo sapiens; identical to SEQ ID NO: 801803

SEQ ID NO: 801808 - protein, 264 aa, Homo sapiens; identical to SEQ ID NO: 801803

SEQ ID NO: 801809 - protein, 248 aa, Homo sapiens; identical to SEQ ID NO: 801802

SEQ ID NO: 801810 - protein, 246 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQTVTSRPSTPTLGTPTPQTMSVSTKVGTPMSLTGQRFTVQMPTSQSPAVKASIPATSAVQNVLINPSLIGSKNILITTNMMSSQNTANESSNALKRKREDDDDDDDDDDDYDNL

SEQ ID NO: 801811 - protein, 252 aa, Homo sapiens
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILIVVCSKYGLELHGGERGSNWHWRRENW

SEQ ID NO: 801812 - protein, 198 aa, Homo sapiens
IRGRVRPREDDKGHVSEAPEAVAAGTMLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 801813 - protein, 94 aa, Homo sapiens
MCHRKPGTPGVGKTTLGKELASKSGLKYINVGDLAREEQLYDGYDEEYDCPILDEDRVVDELDEPDGSKMAIFVTISGFLYIDLLLVITDGSKS

SEQ ID NO: 801814 - protein, 183 aa, Homo sapiens
MPTLQLFAAGTMLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 801815 - protein, 264 aa, Homo sapiens; identical to SEQ ID NO: 801803

SEQ ID NO: 801816 - protein, 264 aa, Homo sapiens; identical to SEQ ID NO: 801803

SEQ ID NO: 801817 - protein, 264 aa, Homo sapiens; identical to SEQ ID NO: 801803

SEQ ID NO: 801818 - protein, 318 aa, Homo sapiens
GNTLGKECVKIRRIINVGDLAQRSLIIGYQESKALQGGHNDCRGGVSAGCVVGGGGGGGGGGGGGGGGGEGGWAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILITTNMMSSQNTANESSNALKRKREDDDDDDDDDDDYDNL

SEQ ID NO: 801819 - protein, 252 aa, Homo sapiens; identical to SEQ ID NO: 801811

SEQ ID NO: 801820 - protein, 246 aa, Homo sapiens; identical to SEQ ID NO: 801810

SEQ ID NO: 801821 - protein, 158 aa, Homo sapiens
IRGRVRPREDDKGHVSEAPEAVAAGTMLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCGDSACAGYRA

SEQ ID NO: 801822 - protein, 152 aa, Homo sapiens
GEVGRAPLDVPGTRTRPRWARAVMVQALHTEPQNMLNKPPKLRGTDLPWGLVIFKMRKRRHSGALIRPREALWVSRRARNRPQLPSLANAQNHYIILPRDPTKRYPHPVAAGAEGLEIGEEAPHTPAPKAMRETEAQEGARSVKRKVGRAGQ

SEQ ID NO: 801823 - protein, 152 aa, Homo sapiens; identical to SEQ ID NO: 801822

SEQ ID NO: 801824 - protein, 112 aa, Homo sapiens
MASLRVERAGGPRLPRTRVGRPAALRLLLLLGAVLNPHEALAQPLPTTGTPGSEGLIAPCEIAWSTLQSCLTWASPIPWQRGSSLRLTRSTLPTAPWCSPPSLTPQRMYSWP

SEQ ID NO: 801825 - protein, 142 aa, Homo sapiens
MSSGVEKLVALGLGSLSLLLHRGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 801826 - protein, 157 aa, Homo sapiens
MASLRVERAGGPRLPRTRVGRPAALRLLLLLGAVLNPHEALAQPLPTTGTPGSEGGTVKNYETAVQFCWNHYKDQMDPIDCLEHFAELFDLGFPNPLAERIIFETHQIHFANCSLVQPTFSDPPEDVLLAMIIAPICLIPFLITLVVWRSKDSEAQA

SEQ ID NO: 801827 - protein, 175 aa, Homo sapiens
MASLRVERAGGPRLPRTRVGRPAALRLLLLLGAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 801828 - protein, 293 aa, Homo sapiens
GGRRERPRRGEGRGERGWMAEAGTGPGVRVRTDVPSSTGPRTVPDPTSGRAQHELLPTQGKLGCWPRPLEEGLGGRKLARDEGALGLGVSDKELVPAPPSPALRRPWGLDYSSFSSKVAYFRRVSVPQPPSQAPLPGSPLCYPPLPFLPTAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 801829 - protein, 112 aa, Homo sapiens; identical to SEQ ID NO: 801824

SEQ ID NO: 801830 - protein, 69 aa, Homo sapiens
VKENQKQPGVGPRHRPGPMPSVLATIPSRLLTVDQHGIASPWSAAEAQKGKGICLKLLSQTEPGFHHVG

SEQ ID NO: 801831 - protein, 373 aa, Homo sapiens
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFDAMVQGKVTPASLIHHTKLCLEKPLGPSVLRHAQQGGFSVKSLGDLMELVFLSLTLSDLPVIDILKIEYIHQETATVLGTEIVAFKEKEVRAKVQHYMAYWMGHREPQGVDVEEAWKCRTCTYADICEWRKGSGVLSSTLAPQVKKAK

SEQ ID NO: 801832 - protein, 175 aa, Homo sapiens
GLWAAFLRVAGRLCSPLRQRALPGFLSLLAGSVREQLRGRGETRWSPRFGGVSEVRGRPENGLGGCVSELRVLSLRSPRLPPLVGAAPGKRLVSSPLTGRVPVLDLRPRNTVLLAGTPSRGGRLPVLIPGSARTVGSAQYTLGHAWHSLGDSALGPEERSSLKANARGAHKSGPH

SEQ ID NO: 801833 - protein, 355 aa, Homo sapiens
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFDAMVQGKVTPASLIHHTKLCLVKSLGDLMELVFLSLTLSDLPVIDILKIEYIHQETATVLGTEIVAFKEKEVRAKVQHYMAYWMGHREPQGVDVEEAWKCRTCTYADICEWRKGSGVLSSTLAPQVKKAK

SEQ ID NO: 801834 - protein, 419 aa, Homo sapiens
GLWAAFLRVAGRLCSPLRQRALPGFLSLLAGSVREQLRGRGETRWSPRFGGVSEGPSSPIQSCTMAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFDAMVQGKVTPASLIHHTKLCLVKSLGDLMELVFLSLTLSDLPVIDILKIEYIHQETATVLGTEIVAFKEKEVRAKVQHYMAYWMGHREPQGVDVEEAWKCRTCTYADICEWRKGSGVLSSTLAPQVKKAK

SEQ ID NO: 801835 - protein, 355 aa, Homo sapiens; identical to SEQ ID NO: 801833

SEQ ID NO: 801836 - protein, 373 aa, Homo sapiens; identical to SEQ ID NO: 801831

SEQ ID NO: 801837 - protein, 355 aa, Homo sapiens; identical to SEQ ID NO: 801833

SEQ ID NO: 801838 - protein, 355 aa, Homo sapiens; identical to SEQ ID NO: 801833

SEQ ID NO: 801839 - protein, 306 aa, Homo sapiens [sequence omitted]

SEQ ID NO: 801840 - protein, 306 aa, Homo sapiens [sequence omitted]

SEQ ID NO: 801841 - protein, 396 aa, Homo sapiens
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLSTSHILNGQVFASRSYFFDRAGHCEDEGCSWEHSRGESTSMSGSLGSGSWYGAIGREPGWYGGSQTKTTPLLFSQVPGPGGHHHSLYSTPQT

SEQ ID NO: 801842 - protein, 306 aa, Homo sapiens [sequence omitted]

SEQ ID NO: 801843 - protein, 375 aa, Homo sapiens
GPARGIRGSAGSGPGAGPGGHLGYGRKFSSETEGRESVAAPGRAARPRFGYRRDERGNWRTPIQASLPDMESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQVGIRMSATSLVAVAPWPQLAWALSHYPFGVTADWHQPLPSHRRTW

SEQ ID NO: 801844 - protein, 243 aa, Homo sapiens
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLRAPSTSIYLEAKGTSVCQAAAMGGAMVLLYASRACYNLTALALAPQSRLDTFDYDWYNVSDQVGIRMSATSLVAVAPWPQLAWALSHYPFGVTADWHQPLPSHRRTW

SEQ ID NO: 801845 - protein, 218 aa, Homo sapiens
MGGAMVLLYASRACYNLTALALAPQSRLDTFDYDWYNVSDQVGIRMSATSFSSRGTLAPAGLGPVPLPLWRDCRLAPAPAFPQADLVNDLGNKGYLVFGLILFVWELLPTTLLVGFFRVHRPPQDLSTSHILNGQVFASRSYFFDRAGHCEDEGCSWEHSRGESTSMSGSLGSGSWYGAIGREPGWYGGSQTKTTPLLFSQVPGPGGHHHSLYSTPQT

SEQ ID NO: 801846 - protein, 271 aa, Homo sapiens
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLADLVNDLGNKGYLVFGLILFVWELLPTTLLVGFFRVHRPPQDLSTSHILNGQVFASRSYFFDRAGHCEDEGCSWEHSRGESTSMSGSLGSGSWYGAIGREPGWYGGSQTKTTPLLFSQVPGPGGHHHSLYSTPQT

SEQ ID NO: 801847 - protein, 169 aa, Homo sapiens
ISRYLAIHLAPVPADLVNDLGNKGYLVFGLILFVWELLPTTLLVGFFRVHRPPQDLSTSHILNGQVFASRSYFFDRAGHCEDEGCSWEHSRGESTRCQDQAATTTVSTPPHRRDPPPSPTEYPGPSPPHPRPLCQVCLPLLAQDPGGRGYPLLWPAPCCSCHSELVPSP

SEQ ID NO: 801848 - protein, 216 aa, Homo sapiens
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKVGLQH

SEQ ID NO: 801849 - protein, 216 aa, Homo sapiens; identical to SEQ ID NO: 801848

SEQ ID NO: 801850 - protein, 216 aa, Homo sapiens; identical to SEQ ID NO: 801848

SEQ ID NO: 801851 - protein, 302 aa, Homo sapiens
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQRTWWMTGEQGYQDGKSSTEEQWQHQNVGTTGERPKTEQKTK

SEQ ID NO: 801852 - protein, 194 aa, Homo sapiens
MNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQVGIRMSATSLVAVAPWPQLAWALSHYPFGVTADWHQPLPSHRRTW

SEQ ID NO: 801853 - protein, 256 aa, Homo sapiens
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGFGSQGVEEAGSLLSLRVLCCYLCQAVGTSVCQAAAMGGAMVLLYASRACYNLTALALAPQSRLDTFDYDWYNVSDQVGIRMSATSLVAVAPWPQLAWALSHYPFGVTADWHQPLPSHRRTW

SEQ ID NO: 801854 - protein, 271 aa, Homo sapiens; identical to SEQ ID NO: 801846

SEQ ID NO: 801855 - protein, 148 aa, Homo sapiens
ISRYLAIHLAPVPADLVNDLGNKGYLVFGLILFVWELLPTTLLVGFFRVHRPPQDLSTSHILNGQVFASRSYFFDRAGHCEDEGCSWEHSRGESTSMSGSLGSGSWYGAIGREPGWYGGSQTKTTPLLFSQVPGPGGHHHSLYSTPQT

SEQ ID NO: 801856 - protein, 108 aa, Homo sapiens
RQGLTASPRLECNGAMTDHCSPNLLGSSDPPTSASRVDGTTGSHHHSHLIFLFYFCRDGVYVAEAGLELLDSRDPPASISRSVGITGVSHHAIFLFFETGSGSVTKAG

SEQ ID NO: 801857 - protein, 119 aa, Homo sapiens
GSSLPPPPAAAAARASQQSRLRSHGPRRPPATPPPRMVAGTSLPYQPSLPGAQLLGPCVTLAFYRDNRETHSNSHGGIGEMAPTAALGGGASERTHAQSACQGGGWRGRANGGGGAQQP

SEQ ID NO: 801858 - protein, 95 aa, Homo sapiens
GSSLPPPPAAAAARASQQSRLRSHGPRRPPATPPPRMVAGTSLPYQPSLPGAQLLGPCVTLAFYRDNRETHSNSHGGIGEMAPTAALGGGASERC

SEQ ID NO: 801859 - protein, 95 aa, Homo sapiens; identical to SEQ ID NO: 801858

SEQ ID NO: 801860 - protein, 113 aa, Homo sapiens
KQTSGGNADWPEAHLLLCCPVPNRPWTCTSLWPEGWGPLIPTRRNLKPRIQAKNNDSQVPMKSWMDVELGNVLADSRGRCEPQQSSRAGTSRERRCVFESESHAVGHLLLSTG

SEQ ID NO: 801861 - protein, 328 aa, Homo sapiens
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADTSP

SEQ ID NO: 801862 - protein, 921 aa, Homo sapiens
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 801863 - protein, 678 aa, Homo sapiens
MAWTARDRGALGLLLLGLCLCAAQRGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 801864 - protein, 552 aa, Homo sapiens
PGPQDPEGPGGPLLPGHQQVLHGPLAPQDPEEQWLSQWISMCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 801865 - protein, 921 aa, Homo sapiens; identical to SEQ ID NO: 801862

SEQ ID NO: 801866 - protein, 477 aa, Homo sapiens
MRFLKIFASTKIIHFSFSHFQGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 801867 - protein, 371 aa, Homo sapiens
MPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 801868 - protein, 241 aa, Homo sapiens
RAGGRALGWRLQQQRETRGNPGNPGLGVAATMTGSNMSDALANAVCQRCQARFSPAERIVNSNGELYHEHCFVCAQCFRPFPEGLFYEFEGRKYCEHDFQMLFAPCCGSCGEFIIGRVIKHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801869 - protein, 554 aa, Homo sapiens
IGSALVWVPHGDVCGRGSQRREQSRMWACVAPVLGFLTVGRDPKGARSSLSSSADSALLSVSTGTGFPPGRWQPETSWVSCRHCGPHLSAVWGLPRPVPSQRDPTPASLSFQELPPRREQYPFYLELTLLPFGDPSAERELATSAGEAPTRPSRLGVWPQAAAPPLRGGPIAPAPGGPRPRPQGGCPAPWRPGWVRWPRRGCTGGASTGRARRQPRSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801870 - protein, 189 aa, Homo sapiens
MFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801871 - protein, 257 aa, Homo sapiens
MEHSAVQDGVQTPSSSRNRLYVFGPFFIWQNPEGRGHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801872 - protein, 188 aa, Homo sapiens
PCRRAGVAPGGCTLSSRKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801873 - protein, 245 aa, Homo sapiens
MRAHHAAAPGWHLTPGAEAAEGEARLGGDGDSQGYHQCLRGGVGSADPRHSQRCQSPLPSVNPERPAPAQTLLSVPFCHCCLLGPLWSPGVTGSWGHCCPRVTTVPRGHRSSPDATRPALCPCSHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801874 - protein, 381 aa, Homo sapiens
RAGGRALGWRLQQQRETRGNPGNPGLGVAATMTGSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLSDSLLGPQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801875 - protein, 372 aa, Homo sapiens
RAGGRALGWRLQQQRETRGNPGNPGLGVAATMTGSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801876 - protein, 372 aa, Homo sapiens; identical to SEQ ID NO: 801875

SEQ ID NO: 801877 - protein, 372 aa, Homo sapiens; identical to SEQ ID NO: 801875

SEQ ID NO: 801878 - protein, 68 aa, Homo sapiens
AGPWEAGPGRCLRGAVLEGQAGCMMALGWGVTACSYSDSLLGPQLFGDVCYNCSHVIEGDGTSLWSST

SEQ ID NO: 801879 - protein, 385 aa, Homo sapiens
AGHSWRLLSLARGCAKRARQLLFPSEKLLAALREGSTRGGGAASQPQSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801880 - protein, 273 aa, Homo sapiens
VTGQSAFPYPGLSPFEAPSCSVKLQGSGLSSPGGGQAVGSGGSAPNAPASRRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801881 - protein, 574 aa, Homo sapiens
IGSALVWVPHGDVCGRGSQRREQSRMWACVAPVLGFLTVGRDPKGARSSLSSSADSALLSVSTGTGFPPGRWQPETSWVSCRHCGPHLSAVWGLPRPVPSQRDPTPASLSFQELPPRREQYPFYLELTLLPFGDPSAERELATSAGEAPTRPSRLGVWPQAAAPPLRGGPIAPAPGGPRPRPQGGCPAPWRPGWVRWPRRGCTGGASTGRARRQPRSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEVSQAGGHVASGWGVPQLRVMHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801882 - protein, 134 aa, Homo sapiens
AGPWEAGPGRCLRGAVLEGQAGCMMALGWGVTACSYSDSLLGPQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 801883 - protein, 372 aa, Homo sapiens; identical to SEQ ID NO: 801875

SEQ ID NO: 801884 - protein, 134 aa, Homo sapiens; identical to SEQ ID NO: 801882

SEQ ID NO: 801885 - protein, 842 aa, Homo sapiens
MAVRPGLWPALLGIVLAAWLRGSGAQQSATVANPVPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTFTLERVSPSTSDLACKLWVWQVEGDGQSFSINFNITKDTRFAELLALESEAGVPALVGPSAFKIPFLIRQKIISSLDPPCRRGADWRTLAQKLHLDSHLSFFASKPSPTAMILNLWEARHFPNGNLSQLAAAVAGLGQPDAGLFTVSEAEC

SEQ ID NO: 801886 - protein, 957 aa, Homo sapiens
PAGTARIRDVQQAGAQQSATVANPVPGANPDLLPHFLVEPEDVYIVKNKPVLLVCKAVPATQIFFKCNGEWVRQVDHVIERSTDGSSEGDREGWRPMKPNRTLGTNTSQDQSLSRPQRRCQRPPCPAAGPTLSCWEGLQENRRVLFCPELRLQPPMAGTSERSLISSISQPKAIECFEVKKKAFLTHGRYHGSGATPPKTKDPKPETFCGQTGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTFTLERVSPSTSDLACKLWVWQVEGDGQSFSINFNITKDTRFAELLALESEAGVPALVGPSAFKIPFLIRQKIISSLDPPCRRGADWRTLAQKLHLDSHLSFFASKPSPTAMILNLWEARHFPNGNLSQLAAAVAGLGQPDAGLFTVSEAEC

SEQ ID NO: 801887 - protein, 842 aa, Homo sapiens; identical to SEQ ID NO: 801885

SEQ ID NO: 801888 - protein, 888 aa, Homo sapiens
PAGTARIRDVQQAGAQQSATVANPVPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVNGGWSTWTEWSVCSASCGRGWQKRSRSCTNPAPLNGGAFCEGQNVQKTACATLCPVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTFTLERVSPSTSDLACKLWVWQVEGDGQSFSINFNITKDTRFAELLALESEAGVPALVGPSAFKIPFLIRQKIISSLDPPCRRGADWRTLAQKLHLDSHLSFFASKPSPTAMILNLWEARHFPNGNLSQLAAAVAGLGQPDAGLFTVSEAEC

SEQ ID NO: 801889 - protein, 713 aa, Homo sapiens
MAVRPGLWPALLGIVLAAWLRGSGAQQSATVANPVPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTTALPPPEAEEFVSRLSTQNYFR

SEQ ID NO: 801890 - protein, 77 aa, Homo sapiens
QKSVRRHFLFKPARSDVAFEERRRGSIINPHFLLQTADATLTAFSAKPAAGKASSPKRKRQDIENHAFPVGRTDDEP

SEQ ID NO: 801891 - protein, 128 aa, Homo sapiens
MVTEPAVSFLGVGDDGERGKNRPLAGPWLGEVLRSAGTLRALCVYRPIPAPTTPSLRPREGHVSMPYRDLKPESLAKFGKKRSPLRAQEPSYSLELFHSRPSLTRVQLKLNIHTHTLTHKLCEPSESK

SEQ ID NO: 801892 - protein, 213 aa, Homo sapiens
MSPDERRKKTRCLRRPKGRGCQEPWRANSSQPPWCKVPRGEEFWSSAYLERCLNSEPGIVSNSRRSGNRLFRCPGALQTNKQQKQMVTEPAVSFLGVGDDGERGKNRPLAGPWLGEVLRSAGTLRALCVYRPIPAPTTPSLRPREGHVSMPYRDLKPESLAKFGKKRSPLRAQEPSYSLELFHSRPSLTRVQLKLNIHTHTLTHKLCEPSESK

SEQ ID NO: 801893 - protein, 102 aa, Homo sapiens
MMGKEERIVRSPDPGLEKFCAPLGLCGPFASTDLSLPRLPLHSDPAFPSVNQNITNCLRIRPTSSPKPGCDRRKPKPELTFPRTRRASLDSQKPCGKGPKIW

SEQ ID NO: 801894 - protein, 77 aa, Homo sapiens
AARIPGLAETLRKRPQDLVRACQLRPPCRGLSPAFLKELKAFGDKSEGVCFKNQMVSWNLTSERFIPSEALTTPIHS

SEQ ID NO: 801895 - protein, 530 aa, Homo sapiens
MRRLWGAARKPSGAGWEKEWAEAPQEAPGAWSGRLGPGRSGRKGRAVPGWASWPAHLALAARPARHLGGAGQGPRPLHSGTAPFHSRASGERQRRLEPQLQHESRCRSSTPADAWRAEAALPVRAMGAPWGSPTAAAGGRRGWRRGRGLPWTVCVLAAAGLTCTALITYACWGQLPPLPWASPTPSRPVGVLLWWEPFGGRDSAPRPPPDCRLRFNISGCRLLTDRASYGEAQAVLFHHRDLVKGPPDWPPPWGIQAHTAEEVDLRVLDYEEAAAAAEALATSSPRPPGQRWVWMNFESPSHSPGLRSLASNLFNWTLSYRADSDVFVPYGYLYPRSHPGDPPSGLAPPLSRKQGLVAWVVSHWDERQARVRYYHQLSQHVTVDVFGRGGPGQPVPEIGLLHTVARYKFYLAFENSQHLDYITEKLWRNALLAGAVPVVLGPDRANYERFVPRGAFIHVDDFPSASSLASYLLFLDRNPAVYRRYFHWRRSYAVHITSFWDEPWCRVCQAVQRAGDRPKSIRNLASWFER

SEQ ID NO: 801896 - protein, 530 aa, Homo sapiens; identical to SEQ ID NO: 801895

SEQ ID NO: 801897 - protein, 108 aa, Homo sapiens
GKQRSWELAVVPGEELLKHETKAQTLLYEKQCSSNLLRADIDLPRSKTVGGDLSAGSRRGRGRRREARAAGTKAADSRRQRLPGREHNPRPYSSEVPHRLLGIKFTFS

SEQ ID NO: 801898 - protein, 78 aa, Homo sapiens
GTGDLHVKSYVEMLEFYGDRDGAQEVLTNYAYDEKFPSNPNAHIYLYNFLKRQKAPRSKLISVLKHLQKISIMYSTLR

SEQ ID NO: 801899 - protein, 450 aa, Homo sapiens
MSDFSEELKGPVTDDEEVETSVLSGAGMHFPWLQTYVETVAIGGKRRKDFAQTTSACLSFIQEALLKHQWQQAAEYMYSYFQTLEDSDSYKRQAAPEIIWKLGSEILFYHPKSNMESFNTFANRMKNIGVMNYLKISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKSEKEEHRKLGLEVLFGVLDFAGCTKNITAWKYLAKYLKNILMGNHLAWVQEEWNSRKNWWPGFHFSYFWAKSDWKEDTALACEKAFVAGLLLGKGCRYFRYILKQDHQILGKKIKRMKRSVKKYSIVNPRL

SEQ ID NO: 801900 - protein, 336 aa, Homo sapiens
MESFNTFANRMKNIGVMNYLKISLQHALYLLHHGMLKDAKRNLSEAETWRHGENTSSREILINLIQAYKGLLQYYTWSEKKMELSKLDKDDYAYNAVAQDVFNHSWKTSANISALIKIPGVWDPFVKSYVEMLEFYGDRDGAQEVLTNYAYDEKFPSNPNAHIYLYNFLKRQKAPRSKLISVLKILYQIVPSHKLMLEFHTLLRKSEKEEHRKLGLEVLFGVLDFAGCTKNITAWKYLAKYLKNILMGNHLAWVQEEWNSRKNWWPGFHFSYFWAKSDWKEDTALACEKAFVAGLLLGKGCRYFRYILKQDHQILGKKIKRMKRSVKKYSIVNPRL

SEQ ID NO: 801901 - protein, 336 aa, Homo sapiens; identical to SEQ ID NO: 801900

SEQ ID NO: 801902 - protein, 299 aa, Homo sapiens [sequence omitted]

SEQ ID NO: 801903 - protein, 95 aa, Homo sapiens
PRPGLLSPSRSRLWGALTPVRRPEVGLRRLLLHSRKIMYQPSRGAARRLGPCLRAYQARPQGPDMVHSFTDPLPFPGLELFCTPSFGGFTADPPP

SEQ ID NO: 801904 - protein, 74 aa, Homo sapiens
QSPSPSVSLPLFPRTYDAYSTFYLNSSGLICRHRLDKLMPSHSPPTPVKKLLVGALVALGLSEPEPDLNLCSKP

SEQ ID NO: 801905 - protein, 352 aa, Homo sapiens
PRPGLLSPSRSRLWGALTPVRRPEVGLRRLLLHSRKIMYQPSRGAARRLGPCLRAYQARPQDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 801906 - protein, 352 aa, Homo sapiens; identical to SEQ ID NO: 801905

SEQ ID NO: 801907 - protein, 165 aa, Homo sapiens
MYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 801908 - protein, 319 aa, Homo sapiens
PRPGLLSPSRSRLWGALTPVRRPEVGLRRLLLHSRKIMYQPSRGAARRLGPCLRAYQARPQDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKVSPR

SEQ ID NO: 801909 - protein, 292 aa, Homo sapiens
PRPGLLSPSRSRLWGALTPVRRPEVGLRRLLLHSRKIMYQPSRGAARRLGPCLRAYQARPQDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYR

SEQ ID NO: 801910 - protein, 104 aa, Homo sapiens
MNAHVVVGPREDDGEWKITGTDNDTEGRKAKKRQATQEKNQEKWKTDKDKKKGGGPRSRTREHLSVMYERLRQELPKLFLQSHDYSLYSLDVEFINEILNIRTK

SEQ ID NO: 801911 - protein, 148 aa, Homo sapiens
LVRPRSKRDEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 801912 - protein, 429 aa, Homo sapiens
ALQRVDRLGVAGAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 801913 - protein, 172 aa, Homo sapiens
MEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 801914 - protein, 319 aa, Homo sapiens; identical to SEQ ID NO: 801908

SEQ ID NO: 801915 - protein, 95 aa, Homo sapiens; identical to SEQ ID NO: 801903

SEQ ID NO: 801916 - protein, 996 aa, Homo sapiens
MKIPNIGNVMNKFEILGVVGEGAYGVVLKCRHKETHEIVAIKKFKDSEENEEVKETTLRELKMLRTLKQENIVELKEAFRRRGKLYLVFEYVEKNMLELLEEMPNGVPPEKVKSYIYQLIKAIHWCHKNDIVHRDIKPENLLISHNDVLKLCDFGFARNLSEGNNANYTEYVATRWYRSPELLLGAPYGKSVDMWSVGCILGELSDGQPLFPGESEIDQLFTIQKVLGPLPSEQMKLFYSNPRFHGLRFPAVNHPQSLERRYLGILNSVLLDLMKNLLKLDPADRYLTEQCLNHPTFQTQRLLDRSPSRSAKRKPYHVESSTLSNRNQAGKSTALQSHHRSNSKDIQNLSVGLPRADEGLPANESFLNGNLAGASLSPLHTKTYQASSQPGSTSKDLTNNNIPHLLSPKEAKSKTEFDFNIDPKPSEGPGTKYLKSNSRSQQNRHSFMESSQSKAGTLQPNEKQSRHSYIDTIPQSSRSPSYRTKAKSHGALSDSKSVSNLSEARAQIAEPSTSRYFPSSCLDLNSPTSPTPTRHSDTRTLLSPSGRNNRNEGTLDSRRTTTRHSKTMEELKLPEHMDSSHSHSLSAPHESFSYGLGYTSPFSSQQRPHRHSMYVTRDKVRAKGLDGSLSIGQGMAARANSLQLLSPQPGEQLPPEMTVARSSVKETSREGTSSFHTRQKSEGGVYHDPHSDDGTAPKENRHLYNDPVPRRVGSFYRVPSPRPDNSFHENISHSEQLKEKEKQGFFRSMKKKKKKSQTVPNSDSPDLLTLQKSIHSASTPSSRPKEWRPEKISDLQTQSQPLKSLRKLLHLSSASNHPASSDPRFQPLTAQQTKNSFSEIRIHPLSQASGGSSNIRQEPAPKGRPALQLPDGGCDGRRQRHHSGPQDRRFMLRTTEQQGEYFCCGDPKKPHTPCVPNRALHRPISSPAPYPVLQVRGTSMCPTLQVRGTDAFSCPTQQSGFSFFVRHVMREALIHRAQVNQAALLTYHENAALTGK

SEQ ID NO: 801917 - protein, 996 aa, Homo sapiens; identical to SEQ ID NO: 801916

SEQ ID NO: 801918 - protein, 1030 aa, Homo sapiens
MKIPNIGNVMNKFEILGVVGEGAYGVVLKCRHKETHEIVAIKKFKDSEENEEVKETTLRELKMLRTLKQENIVELKEAFRRRGKLYLVFEYVEKNMLELLEEMPNGVPPEKVKSYIYQLIKAIHWCHKNDIVHRDIKPENLLISHNDVLKLCDFGFARNLSEGNNANYTEYVATRWYRSPELLLGAPYGKSVDMWSVGCILGELSDGQPLFPGESEIDQLFTIQKVLGPLPSEQMKLFYSNPRFHGLRFPAVNHPQSLERRYLGILNSVLLDLMKNLLKLDPADRYLTEQCLNHPTFQTQRLLDRSPSRSAKRKPYHVESSTLSNRNQAGKSTALQSHHRSNSKDIQNLSVGLPRADEGLPANESFLNGNLAGASLSPLHTKTYQASSQPGSTSKDLTNNNIPHLLSPKEAKSKTEFDFNIDPKPSEGPGTKYLKSNSRSQQNRHSFMESSQSKAGTLQPNEKQSRHSYIDTIPQSSRSPSYRTKAKSHGALSDSKSVSNLSEARAQIAEPSTSRYFPSSCLDLNSPTSPTPTRHSDTRTLLSPSGRNNRNEGTLDSRRTTTRHSKTMEELKLPEHMDSSHSHSLSAPHESFSYGLGYTSPFSSQQRPHRHSMYVTRDKVRAKGLDGSLSIGQGMAARANSLQLLSPQPGEQLPPEMTVARSSVKETSREGTSSFHTRQKSEGGVYHDPHSDDGTAPKENRHLYNDPVPRRVGSFYRVPSPRPDNSFHENNVSTRVSSLPSESSSGTNHSKRQPAFDPWKSPENISHSEQLKEKEKQGFFRSMKKKKKKSQTVPNSDSPDLLTLQKSIHSASTPSSRPKEWRPEKISDLQTQSQPLKSLRKLLHLSSASNHPASSDPRFQPLTAQQTKNSFSEIRIHPLSQASGGSSNIRQEPAPKGRPALQLPDGGCDGRRQRHHSGPQDRRFMLRTTEQQGEYFCCGDPKKPHTPCVPNRALHRPISSPAPYPVLQVRGTSMCPTLQVRGTDAFSCPTQQSGFSFFVRHVMREALIHRAQVNQAALLTYHENAALTGK

SEQ ID NO: 801919 - protein, 289 aa, Homo sapiens
CDLGVSESGLFGVERRSGKSPENISHSEQLKEKEKQGFFRSMKKKKKKSQTVPNSDSPDLLTLQKSIHSASTPSSRPKEWRPEKISDLQTQSQPLKSLRKLLHLSSASNHPASSDPRFQPLTAQQTKNSFSEIRIHPLSQASGGSSNIRQEPAPKGRPALQLPDGGCDGRRQRHHSGPQDRRFMLRTTEQQGEYFCCGDPKKPHTPCVPNRALHRPISSPAPYPVLQVRGTSMCPTLQVRGTDAFSCPTQQSGFSFFVRHVMREALIHRAQVNQAALLTYHENAALTGK

SEQ ID NO: 801920 - protein, 260 aa, Homo sapiens
AAHTASHNHTLTATNPQSHAHADAPCGTCTHNHTCVQSGRHNHTCIEASLWTPSASHRGGSPAVFDWFFEAACPASLQEDPPILRQFPPDFRDQEAMQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLTCFRGPRDSGRLAIPSLEKQGTYSETGWEDSDLTRT

SEQ ID NO: 801921 - protein, 233 aa, Homo sapiens [sequence omitted]

SEQ ID NO: 801922 - protein, 812 aa, Homo sapiens
TQEAEPAWGPAYTGPQDPWGEGPAGLALQGPWNPELNPPILRQFPPDFRDQEAMQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASPGALRSYQLWADNLKKGGGALLHSVKAKTQPAVKNMYRSAKSGLKGVQSLLMYKDGDSVLQRGGSLRAPALPSRSDRLQQRLPITQHFGKFENRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 801923 - protein, 309 aa, Homo sapiens
IFSAEAQEKFGKDKSIGSSHRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 801924 - protein, 284 aa, Homo sapiens
LEDLQRHKEAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 801925 - protein, 87 aa, Homo sapiens
RLLRWTFDKLLFDIAWTSQPLDPSSDPSSLEDPRARPPKALLAERAHLQPREEPGALNSPATPTSNCQKSQPSSRPRVADLKKCFEG

SEQ ID NO: 801926 - protein, 506 aa, Homo sapiens
MESRAEGGSPAVFDWFFEAACPASLQEDPPILRQFPPDFRDQEAMQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASPGALRSYQLWADNLKKGGGALLHSVKAKTQPAVKNMYRSAKSGLKGVQSLLMYKVRSTGRVQWLTPVIPALWEAEAGGLLEPRSLRPAWAI

SEQ ID NO: 801927 - protein, 103 aa, Homo sapiens
MWHPLHTHPSPASLSPPILQSPEVLSPPPFAEPAPSPQQETPAGRGNFRAPRGGVRQKGNSSVESGRPGLMGRRVPKLQSSLTRAGGLGQISEAAHPHPGHPH

SEQ ID NO: 801928 - protein, 803 aa, Homo sapiens
MESRAEGGSPAVFDWFFEAACPASLQEDPPILRQFPPDFRDQEAMQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASPGALRSYQLWADNLKKGGGALLHSVKAKTQPAVKNMYRSAKSGLKGVQSLLMYKDGDSVLQRGGSLRAPALPSRSDRLQQRLPITQHFGKFENRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 801929 - protein, 108 aa, Homo sapiens
LRVLGALLGSGDILRQLGCPGLSNSPSHSREPPSPAVQHFTFALTDLAGNRRFGFCRLRAGTQSCLCILSHLPWFEVFYKLLNTVGDLLAQDQVRPAPLSLLWESQPP

SEQ ID NO: 801930 - protein, 668 aa, Homo sapiens
MISKGVRVVTHYPAVDGEGEQETGDVGNAAGRDLALEGPGPDSTPRHRSPADLVRPRVLRAPVPHALGARADPHAAPTPAGLLLRAHALPHWSARQSRRGERGSTQDDGDVRVPPSSTSPDALLCQGLPGSERPTPLFLQRVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASPGALRSYQLWADNLKKGGGALLHSVKAKTQPAVKNMYRSAKSGLKGVQSLLMYKDGDSVLQRGGSLRAPALPSRSDRLQQRLPITQHFGKFENRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 801931 - protein, 355 aa, Homo sapiens
AGITGAHHHPRLIFVFLVETGFHHVGQAGLELLTSGDPLTLASQSAGITVVSHHARPLQNRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 801932 - protein, 803 aa, Homo sapiens; identical to SEQ ID NO: 801928

SEQ ID NO: 801933 - protein, 463 aa, Homo sapiens
MESRAEGGSPAVFDWFFEAACPASLQEDPPILRQFPPDFRDQEAMQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASKGGGALLHSVKAKTQPAVKNMYRSARVVEGGAELLMLRGGTAGKGGPR

SEQ ID NO: 801934 - protein, 87 aa, Homo sapiens
ARDGFYILTAGRLRSAGIQMCLLLFLIYCPPPQFIEARLEKLNKGEGFSDQFEQEITGCGASQVSPESSPWVPHYPPPAPPASASLR

SEQ ID NO: 801935 - protein, 465 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 801936 - protein, 465 aa, Homo sapiens; identical to SEQ ID NO: 801935

SEQ ID NO: 801937 - protein, 368 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKDWEIKIIITNERQMGIIYLQMSYPEKAITSPTQDSS

SEQ ID NO: 801938 - protein, 465 aa, Homo sapiens; identical to SEQ ID NO: 801935

SEQ ID NO: 801939 - protein, 465 aa, Homo sapiens; identical to SEQ ID NO: 801935

SEQ ID NO: 801940 - protein, 459 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHECEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 801941 - protein, 378 aa, Homo sapiens
MNVTSLFSFTSPAVKRLLGWKQGDEEEKWQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 801942 - protein, 300 aa, Homo sapiens
MPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 801943 - protein, 465 aa, Homo sapiens; identical to SEQ ID NO: 801935

SEQ ID NO: 801944 - protein, 465 aa, Homo sapiens; identical to SEQ ID NO: 801935

SEQ ID NO: 801945 - protein, 465 aa, Homo sapiens; identical to SEQ ID NO: 801935

SEQ ID NO: 801946 - protein, 465 aa, Homo sapiens; identical to SEQ ID NO: 801935

SEQ ID NO: 801947 - protein, 459 aa, Homo sapiens; identical to SEQ ID NO: 801940

SEQ ID NO: 801948 - protein, 236 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPGKGFLGLSWRP

SEQ ID NO: 801949 - protein, 676 aa, Homo sapiens
GGCWEGRRDGGGGTGSRVRVRVKREAARVGAGPEHQAQARRPPARTLVLTDATAMAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801950 - protein, 663 aa, Homo sapiens
GLLGRPAGWRRRDRLAGAGPGEAGGSQSRSRARAPGADATAMAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801951 - protein, 663 aa, Homo sapiens; identical to SEQ ID NO: 801950

SEQ ID NO: 801952 - protein, 657 aa, Homo sapiens
RRPGTACLPNPGRTAVWPQARRPPARTLVLTDATAMAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801953 - protein, 592 aa, Homo sapiens
WYPSGIPGYSQNHAVRRRDRLAGAGPGEAGGSQSRSRARAPGADATAMAMMVFPREEKLSQDEIVLGTKAVIQGLETLRGEHRALLAPLVAPEAGEAEPGSQERCILLRRSLEAIELGLGEAQEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801954 - protein, 663 aa, Homo sapiens; identical to SEQ ID NO: 801950

SEQ ID NO: 801955 - protein, 663 aa, Homo sapiens; identical to SEQ ID NO: 801950

SEQ ID NO: 801956 - protein, 321 aa, Homo sapiens
ARYHLSTLEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801957 - protein, 210 aa, Homo sapiens
MLCLGAKESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801958 - protein, 130 aa, Homo sapiens
AYTVVQAGWESAEGNLLPCHLSLSPGGWACPLQLHPLFIPSSRALFPRFGPAGGAGWSLHHRLSGLASPDPRAKNTKHSPALRHPRPPSRLNPAVASVYREISYWPRASLQSTVLPGPPLVPLLVVPPRP

SEQ ID NO: 801959 - protein, 249 aa, Homo sapiens
GGCWEGRRDGGGGTGSRVRVRVKREAARVGAGPEHQAQARRPPARTLVLTDATAMAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPLLRVRRLLSIFRCCCRNKDGLNLKKK

SEQ ID NO: 801960 - protein, 115 aa, Homo sapiens
MLKGQPVTRAPTWHTPLTPALRMGLLLVPPVSPTAPVFSVQSQGNLLPCHLSLSPGGWACPLQLHPLFIPSSRALFPRFGPAGGAGWSLHHRLSGLASPDPRAKNTKHSPALRHP

SEQ ID NO: 801961 - protein, 212 aa, Homo sapiens
GTRRVFRDIVRTTLLGGGTGSRVRVRVKREAARVGAGPEHQAQARRPPARTLVLTDATAMAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPN

SEQ ID NO: 801962 - protein, 564 aa, Homo sapiens
LVEAGFKSDEDELGLGEAVILALSSHLGAVESEKQKLRAQVRRLVQENQWLREELAGTQQKLQRSEQAVAQLEEEKQHLLFMSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801963 - protein, 661 aa, Homo sapiens
GPRSFKAANGPREACFAPSDATEARRPPARTLVLTDATAMAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801964 - protein, 210 aa, Homo sapiens
MHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 801965 - protein, 663 aa, Homo sapiens; identical to SEQ ID NO: 801950

SEQ ID NO: 801966 - protein, 663 aa, Homo sapiens; identical to SEQ ID NO: 801950

SEQ ID NO: 801967 - protein, 160 aa, Homo sapiens [sequence omitted]

SEQ ID NO: 801968 - protein, 74 aa, Homo sapiens
QRSEQAVAQLEEEKQHLLFMSQIRKLDEDASPNVSSYHGHCCPARRPGSREGQHGADSAPPQPMDTPAALCLLP

SEQ ID NO: 801969 - protein, 78 aa, Homo sapiens
EKMGILSVDLLITLQILPVFFSNCLFLALYDSVILLKHVVLLLSRSKSTRGEWRRMLTSEGLRCVWKSFLLDAYKQVS

SEQ ID NO: 801970 - protein, 1078 aa, Homo sapiens
LQAQNGAALASGSPYTNGPVQNALLSSQESVSQGYNFQLPGSYPHPITSKDFDPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKELVQDLLKTLPQMFTKTLETQSALGPALQAAFKLMSPTGGRMSVFQTQLPTLGVGALKPREEPNHRSSAKDIHMTPSTDFYKKLALDCSGQQVAVDLFLLSGQYSDLASLGCISRYSAGSVYYYPSYHHQHNPVQVQKLQKELQRYLTRKIGFEAVMRIRCTKGLSIHTFHGNFFVRSTDLLSLPNVNPDAGYAVQMSVEESLTDTQLVSFQSALLYTSSKGERRIRVHTLCLPVVSTLNDVFLGADVQAISGLLANMAVDRSMTASLSDARDALVNAVIDSLSAYRSSVLSNQQPGLMVPFSLRLFPLFVLALLKQKSFQTGTNARLDERIFAMCQVKNQPLVYLMLTTHPSLYRVDNLSDEGALNISDRTIPQPPILQLSVEKLSRDGAFLMDAGSVLMLWVGKNCTQNFLSQVLGVQNYASIPQPMTDLPELDTPESARIIAFISWLREQRPFFPILYVIRDESPMKANFLQNMIEDRTESALSYYEFLLHIQQQVNK

SEQ ID NO: 801971 - protein, 1078 aa, Homo sapiens; identical to SEQ ID NO: 801970

SEQ ID NO: 801972 - protein, 1078 aa, Homo sapiens; identical to SEQ ID NO: 801970

SEQ ID NO: 801973 - protein, 1078 aa, Homo sapiens; identical to SEQ ID NO: 801970

SEQ ID NO: 801974 - protein, 1014 aa, Homo sapiens
LQAQNGAALASGSPYTNGPVQNALLSSQESVSQGYNFQLPGSYPHPITSKDFDPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKELVQDLLKTLPQMFTKTLETQSALGPALQAAFKLMSPTGGRMSVFQTQLPTLGVGALKPREEPNHRSSAKDIHMTPSTDFYKKLALDCSGQQVAVDLFLLSGQYSDLASLGCISRYSAGSVYYYPSYHHQHNPVQVQKLQKELQRYLTRKIGFEAVMRIRCTKGLSIHTFHGNFFVRSTDLLSLPNVNPDAGYAVQMSVEESLTDTQLVSFQSALLYTSSKGERRIRVHTLCLPVVSTLNDVFLGADVQAISGLLANMAVDRSMTASLSDARDALVNAVIDSLSAYRSSVLSNQQPGLMVPFSLRLFPLFVLALLKQKSFQTGTNARLDERIFAMCQVKNQPLVYLMLTTHPSLYRVDNLSDEGALNISDRTIPQPPILQLSVEKLSRDGAFLMDAGSVLMLWVGKNCTQNFLSQVLGVQNYASIPQPMPFSSKSWE

SEQ ID NO: 801975 - protein, 467 aa, Homo sapiens
LQAQNGAALASGSPYTNGPVQNALLSSQESVSQGYNFQLPGSYPHPITSKDFDPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVRPGLSLSPRLECSSMIIAHCSLELLGSSSPPASASRQTIACGYLQYNCEMPFMQDVHQSFRQLS

SEQ ID NO: 801976 - protein, 152 aa, Homo sapiens
PPGPERSRLGLGVSLHQRSCPKCIAVFTRVSEPRIQFPASRILPSSNTSKDFDPVSGQSNYGGSQGSGQTLNRPPVASNPVTPSLHSGPAPRMPLPASQNPATTPMPSSSFLPEANLPPPLNWQYNYPVHSLHKQTIVLVHHPNQLYLEIQV

SEQ ID NO: 801977 - protein, 1078 aa, Homo sapiens; identical to SEQ ID NO: 801970

SEQ ID NO: 801978 - protein, 748 aa, Homo sapiens
KVRGRVLLGRERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKELVQDLLKTLPQMFTKTLETQSALGPALQAAFKLMSPTGGRMSVFQTQLPTLGVGALKPREEPNHRSSAKDIHMTPSTDFYKKLALDCSGQQVAVDLFLLSGQYSDLASLGCISRYSAGSVYYYPSYHHQHNPVQVQKLQKELQRYLTRKIGFEAVMRIRCTKGLSIHTFHGNFFVRSTDLLSLPNVNPDAGYAVQMSVEESLTDTQLVSFQSALLYTSSKGERRIRVHTLCLPVVSTLNDVFLGADVQAISGLLANMAVDRSMTASLSDARDALVNAVIDSLSAYRSSVLSNQQPGLMVPFSLRLFPLFVLALLKQKSFQTGTNARLDERIFAMCQVKNQPLVYLMLTTHPSLYRVDNLSDEGALNISDRTIPQPPILQLSVEKLSRDGAFLMDAGSVLMLWVGKNCTQNFLSQVLGVQNYASIPQPMTDLPELDTPESARIIAFISWLREQRPFFPILYVIRDESPMKANFLQNMIEDRTESALSYYEFLLHIQQQVNK

SEQ ID NO: 801979 - protein, 289 aa, Homo sapiens
MAIGIFFLSNWFLGKLHSSPQWSSDQMELSSSSSPLDKAKGYVANMAVDRSMTASLSDARDALVNAVIDSLSAYRSSVLSNQQPGLMVPFSLRLFPLFVLALLKQKSFQTGTNARLDERIFAMCQVKNQPLVYLMLTTHPSLYRVDNLSDEGALNISDRTIPQPPILQLSVEKLSRDGAFLMDAGSVLMLWVGKNCTQNFLSQVLGVQNYASIPQPMTDLPELDTPESARIIAFISWLREQRPFFPILYVIRDESPMKANFLQNMIEDRTESALSYYEFLLHIQQQVNK

SEQ ID NO: 801980 - protein, 1078 aa, Homo sapiens; identical to SEQ ID NO: 801970

SEQ ID NO: 801981 - protein, 589 aa, Homo sapiens
LQAQNGAALASGSPYTNGPVQNALLSSQESVSQGYNFQLPGSYPHPITSKDFDPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKEVRHIFLPDMFN

SEQ ID NO: 801982 - protein, 504 aa, Homo sapiens
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 801983 - protein, 422 aa, Homo sapiens
MTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 801984 - protein, 422 aa, Homo sapiens; identical to SEQ ID NO: 801983

SEQ ID NO: 801985 - protein, 422 aa, Homo sapiens; identical to SEQ ID NO: 801983

SEQ ID NO: 801986 - protein, 504 aa, Homo sapiens; identical to SEQ ID NO: 801982

SEQ ID NO: 801987 - protein, 491 aa, Homo sapiens
MSQPRTPEQALDTPGDCPPGRRDEDAGEGIQCSQRMLSFSDALLSIIATVMQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 801988 - protein, 375 aa, Homo sapiens [sequence omitted]

SEQ ID NO: 801989 - protein, 481 aa, Homo sapiens
AGTAGSMGSPGRADSSGGARNSRRGDSRPAVRQKCTEASGNTDCRLPDDLSHRDSGLGSTHKVVPSCWENRRHTCPAQPGRIMAVMPSLPPACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 801990 - protein, 461 aa, Homo sapiens
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLL

SEQ ID NO: 801991 - protein, 312 aa, Homo sapiens
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSRDLADIGEEMRVRP

SEQ ID NO: 801992 - protein, 237 aa, Homo sapiens [sequence omitted]

SEQ ID NO: 801993 - protein, 104 aa, Homo sapiens
QGKPSHGQAAVVLAWPGFIFIVKYHALISVLKLFSTFCGERSFTGTGNVLYGICLSTLSNLKTRCQAHLPEGQPTPSPFEAYTELVGSGVPSQALPSPRLLTQR

SEQ ID NO: 801994 - protein, 236 aa, Homo sapiens
LRLVETPWCSAEGEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 801995 - protein, 422 aa, Homo sapiens; identical to SEQ ID NO: 801983

SEQ ID NO: 801996 - protein, 485 aa, Homo sapiens
RRGGLTETARARRRRACDELPAVKLPAGLTQAEARGTVAEAIPAQQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 801997 - protein, 504 aa, Homo sapiens; identical to SEQ ID NO: 801982

SEQ ID NO: 801998 - protein, 422 aa, Homo sapiens; identical to SEQ ID NO: 801983

SEQ ID NO: 801999 - protein, 483 aa, Homo sapiens
RLVRPEVWDLPAGLTQAEARGTVAEAIPAQILPVTHTEISPEQQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 802000 - protein, 406 aa, Homo sapiens
DGNPCCQKPLYTSVERACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 802001 - protein, 231 aa, Homo sapiens [sequence omitted]

SEQ ID NO: 802002 - protein, 130 aa, Homo sapiens
MTFLIVTVAWAAHTRLFQVVGKTDDTLALLNLACMMTITFLPYTVSNTRPLTPEALLGTTGFDLSSKADQLDGPGPRPHGCREERRFWGEPAVGLLGASFRLAGRGGSGPDEGVTGAPSSHPALSPQPPA

SEQ ID NO: 802003 - protein, 306 aa, Homo sapiens
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRENVLRNLADKAFDRPICEALLDQRFFNGIGNYLRAEILYRLKIPPFEKARSVLEALQQHRPSPELTLSQKIRTKLQNPDLLELCHSVPKEVVQLGGRGYGSESGEEDFAAFRAWLRCYGMPGMSSLQDRHGRTIWFQGDPGPLAPKAQVPQKEIQGHTAES

SEQ ID NO: 802004 - protein, 123 aa, Homo sapiens
MEGGDGSYAPRPCSSRENVLRNLADKAFDRPICEALLDQRFFNGIGNYLRAEILYRLKIPPFEKARSVLEALQQHRPSPELTLSQKIRTKLQNPDLLELCHSVPKEVVQLGEAKDGSNLCFSK

SEQ ID NO: 802005 - protein, 338 aa, Homo sapiens
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRENVLRNLADKAFDRPICEALLDQRFFNGIGNYLRAEILYRLKIPPFEKARSVLEALQQHRPSPELTLSQKIRTKLQNPDLLELCHSVPKEVVQLGGRGYGSESGEEDFAAFRAWLRCYGMPGMSSLQDRHGRTIWFQVGPYCSHRQRPQEADGWKRGVTITGVVMLRVCLDPPRTTLFLRVTPLPSHASQGCS

SEQ ID NO: 802006 - protein, 390 aa, Homo sapiens
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRVSLCCLGWSTVAPSQLIAALTSRAQRNRFSEPLSPSHGGWGWVLRTQTVFLQENVLRNLADKAFDRPICEALLDQRFFNGIGNYLRAEILYRLKIPPFEKARSVLEALQQHRPSPELTLSQKIRTKLQNPDLLELCHSVPKEVVQLGGRGYGSESGEEDFAAFRAWLRCYGMPGMSSLQDRHGRTIWFQVGPYCSHRQRPQEADGWKRGVTITGVVMLRVCLDPPRTTLFLRVTPLPSHASQGCS

SEQ ID NO: 802007 - protein, 338 aa, Homo sapiens; identical to SEQ ID NO: 802005

SEQ ID NO: 802008 - protein, 338 aa, Homo sapiens; identical to SEQ ID NO: 802005

SEQ ID NO: 802009 - protein, 338 aa, Homo sapiens; identical to SEQ ID NO: 802005

SEQ ID NO: 802010 - protein, 355 aa, Homo sapiens
MGRTGPRAPLLPKTRIWSLTFSRKTSPAHLRLRFRTARGQRQVAKQGGRRTLPPSLRMPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRLKIPPFEKARSVLEALQQHRPSPELTLSQKIRTKLQNPDLLELCHSVPKEVVQLGGRGYGSESGEEDFAAFRAWLRCYGMPGMSSLQDRHGRTIWFQVGPYCSHRQRPQEADGWKRGVTITGVVMLRVCLDPPRTTLFLRVTPLPSHASQGCS

SEQ ID NO: 802011 - protein, 338 aa, Homo sapiens; identical to SEQ ID NO: 802005

SEQ ID NO: 802012 - protein, 338 aa, Homo sapiens; identical to SEQ ID NO: 802005

SEQ ID NO: 802013 - protein, 338 aa, Homo sapiens; identical to SEQ ID NO: 802005

SEQ ID NO: 802014 - protein, 123 aa, Homo sapiens; identical to SEQ ID NO: 802004

SEQ ID NO: 802015 - protein, 306 aa, Homo sapiens; identical to SEQ ID NO: 802003

SEQ ID NO: 802016 - protein, 338 aa, Homo sapiens; identical to SEQ ID NO: 802005

SEQ ID NO: 802017 - protein, 424 aa, Homo sapiens
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRENVLRNLADKAFDRPICEALLDQRFFNGIGNYLRAEILYRLKIPPFEKARSVLEALQQHRPSPELTLSQKIRTKLQNPDLLELCHSVPKEVVQLGGRGYGSESGEEDFAAFRAWLRCYGMPGMSSLQDRHGRTIWFQAKRAERTSRLQGLQHPSPPYPPATLGVTPGQDRTLQLQHQCPAGRKSRKKKSKATQLSPEDRVEDALPPSKAPSRTRRAKRDLPKRTATQRPEGTSLQQDPEAPTVPKKGRRKGRQAASGHCRPRKVKADIPSLEPEGTSAS

SEQ ID NO: 802018 - protein, 209 aa, Homo sapiens
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRLKIPPFEKARSVLEALQQHRPSPELTLSQKIRTKLQNPDLLELCHSVPKEVVQLGGSWTVGTQR

SEQ ID NO: 802019 - protein, 338 aa, Homo sapiens; identical to SEQ ID NO: 802005

SEQ ID NO: 802020 - protein, 338 aa, Homo sapiens; identical to SEQ ID NO: 802005

SEQ ID NO: 802021 - protein, 200 aa, Homo sapiens
MPEGPELHLASQFVNEACRALVFGGCVEKSSVSRNPEVPENVLRNLADKAFDRPICEALLDQRFFNGIGNYLRAEILYRLKIPPFEKARSVLEALQQHRPSPELTLSQKIRTKLQNPDLLELCHSVPKEVVQLGGRGYGSESGEEDFAAFRAWLRCYGMPGMSSLQDRHGRTIWFQGDPGPLAPKAQVPQKEIQGHTAES

SEQ ID NO: 802022 - protein, 252 aa, Homo sapiens
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRENVLRNLADKAFDRPICEALLDQRFFNGIGNYLRAEILYRLKIPPFEKARSVLEALQQHRPSPELTLSQKIRTKLQNPDLLELCHSVPKEVVQLGEAKDGSNLCFSK

SEQ ID NO: 802023 - protein, 123 aa, Homo sapiens; identical to SEQ ID NO: 802004

SEQ ID NO: 802024 - protein, 86 aa, Homo sapiens
SCSFKGVMERRGGDKERMDDERRPTKDNGHLLSMEEMRTGRLRIKRRKPQGEELMSAAAPTLGTFANLGYRREAENPGYAQSQNCC

SEQ ID NO: 802025 - protein, 129 aa, Homo sapiens
MRTHQFSTSPGRCVGKGGRPGWLGLGRGEPSPARAPGPGPLSTGPAARAWLPGSTSCERGPWPGAQQPPRGTRQPAERTRGDKLEDRGPAQLHLGQSQPSGRVYAPPVAGYPAQQLQLHCPPKTLGLAG

SEQ ID NO: 802026 - protein, 647 aa, Homo sapiens
SIRGTLSPKDALTDLTGDAERLPVEGHHGTWLGHKGMVLSAEYIKKKLEQEMVLSQAFGRDLGRGTKHYGLIVVGHSLGAGTAAILSFLLRPQYPTLKCFAYSPPGGLLSEDAMEYSKEFVTAVVLGKDLVPRIGLSQLEGFRRQLLDVLQRSTKPKWRIIVGATKCIPKSELPEEVEVTTLASTRLWTHPSDLTIALSASTPLYPPGRIIHVVHNHPAEQCCCCEQEEPTYFAIWGDNKAFNEVIISPAMLHEHLPYVVMEGLNKVLENYNKGKTALLSAAKVMVSPTEVDLTPELIFQQQPLPTGPPMPTGLALELPTADHRNSSVRSKSQSEMSLEGFSEGRLLSPVVAAAARQDPVELLLLSTQERLAAELQARRAPLATMESLSDTESLYSFDSRRSSGFRSIRGSPSLHAVLERDEGHLFYIDPAIPEENPSLSSRTELLAADSLSKHSQDTQPLEAALGSGGVTPERPPSAAANDEEEEVGGGGGGPASRGELALHNGRLGDSPSPQVLEFAEFIDSLFNLDSKSSSFQDLYCMVVPESPTSDYAEGPKSPSQQEILLRAQFEPNLVPKPPRLFAGSADPSSGISLSPSFPLSSSGELMDLTPTGLSSQECLAADKIRTSTPTGHGASPAKQDELVISAR

SEQ ID NO: 802027 - protein, 97 aa, Homo sapiens
TPKTVLLGLSGAPHLSNPGTAYHANQEEGSQGGVGEDGKGLDIHGRVEGDNTACIANPGEKDGLPRKWCQNNSLFIWKKMKMIPYVIPHIKNPFQMD

SEQ ID NO: 802028 - protein, 156 aa, Homo sapiens
MSTQRQNGQAHSQADATDVTLVILVESSDHGCRFCRAKSDELCTHRGSAGSGCARLFWKASCCNCRRMRFACCLSASRSSAVCRLHREQAVTCQEHRPSSRVCPTPGAFPGDKLNERCSPLQSPNPVWAPITRSLLLRVLTPTKTGNPKADGAKVS

SEQ ID NO: 802029 - protein, 112 aa, Homo sapiens
MHARGPHGQLSPALPLASSVLMLLMSTLWLVGAGPGLVLAPELLLDPWQGEGQPRGPWRKQETCCRAWAHLAGAAQGLQGQTGMGPSVPGKHGLRQEHAQHIHSQEGRQRTP

SEQ ID NO: 802030 - protein, 250 aa, Homo sapiens
MIKCWLWEDWLLGRGGGLSRWPWCSVTFNLAHLGQPWMLGPLTWHISPFSLPVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLACILCLSPGPVGMCGFCGWVPGKEVAQRGEGPSNTKEPCTHIPGASLSLPLGHALGWDLGSYGLVEVPITM

SEQ ID NO: 802031 - protein, 338 aa, Homo sapiens
MVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVQPTWEGSSEAGLDWAGASFSPGTPMWAALDEQMLQEGIQASLLDGPAQEPQSAPWLSKSSVSSLRLQQLERMGFPTEQAVVALAATGRVEGAVSLLVGGQVGTETLVTHGKGGPAHSEGPGPP

SEQ ID NO: 802032 - protein, 389 aa, Homo sapiens
MIKCWLWEDWLLGRGGGLSRWPWCSVTFNLAHLGQPWMLGPLTWHISPFSLPVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVQPTWEGSSEAGLDWAGASFSPGTPMWAALDEQMLQEGIQASLLDGPAQEPQSAPWLSKSSVSSLRLQQLERMGFPTEQAVVALAATGRVEGAVSLLVGGQVGTETLVTHGKGGPAHSEGPGPP

SEQ ID NO: 802033 - protein, 419 aa, Homo sapiens
MLGAEERASLHPLIHIIFQFQLKGDKTRSLYSQQESDKLIFKNMISNLIFMTQHLHPKVNRPIFQPWMLGPLTWHISPFSLPVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVQPTWEGSSEAGLDWAGASFSPGTPMWAALDEQMLQEGIQASLLDGPAQEPQSAPWLSKSSVSSLRLQQLERMGFPTEQAVVALAATGRVEGAVSLLVGGQVGTETLVTHGKGGPAHSEGPGPP

SEQ ID NO: 802034 - protein, 273 aa, Homo sapiens
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVPAHSEGPGPP

SEQ ID NO: 802035 - protein, 247 aa, Homo sapiens
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLACILCLSPGPVGMCGFCGWVPGKEVAQRGEGPSNTKEPCTHIPGASLSLPLGHALGWDLGSYGLVEVPITM

SEQ ID NO: 802036 - protein, 386 aa, Homo sapiens
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVQPTWEGSSEAGLDWAGASFSPGTPMWAALDEQMLQEGIQASLLDGPAQEPQSAPWLSKSSVSSLRLQQLERMGFPTEQAVVALAATGRVEGAVSLLVGGQVGTETLVTHGKGGPAHSEGPGPP

SEQ ID NO: 802037 - protein, 386 aa, Homo sapiens; identical to SEQ ID NO: 802036

SEQ ID NO: 802038 - protein, 338 aa, Homo sapiens; identical to SEQ ID NO: 802031

SEQ ID NO: 802039 - protein, 318 aa, Homo sapiens
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVRTPERTMAVQVLCLLSAAAAAGAHGLPYGAGGGGTGSHRPCGGCRVTVGWRTSGH

SEQ ID NO: 802040 - protein, 334 aa, Homo sapiens
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVQPTWEGSSEAGLDWAGASFSPGTPMWAALDEQMLQEGIQASLLDGPAQEPQSAPWLSKSSVSSLRPSSYSV

SEQ ID NO: 802041 - protein, 150 aa, Homo sapiens
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGGGWTRTSAVEAGCWREEGGPSAQ

SEQ ID NO: 802042 - protein, 748 aa, Homo sapiens
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGGTYQGQWVGGMRQGYGVRQSVPYGMAAVIRSPLRTSINSLRSEHTNGTALHPDASPAVAGSPAVSRGGFVLVAHSDSEILKSKKKGLFRRSLLSGLKLRKSESKSSLASQRSKQSSFRSEAGMSTVSSTASDIHSTISLGEAEAELAVIEDDIDATTTETYVGEWKNDKRSGFGVSQRSDGLKYEGEWASNRRHGYGCMTFPDGTKEEGKYKQNILVGGKRKNLIPLRASKIREKVDRAVEAAERAATIAKQKAEIAASRTSHSRAKAEAALTAAQKAQEEARIARITAKEFSPSFQHRENGLEYQRPKRQTSCDDIEVLSTGTPLQQESPELYRKGTTPSDLTPDDSPLQSFPTSPAATPPPAPAARNKVAHFSRQVSVDEERGGDIQMLLEGRAGDCARSSWGEEQAGGSRGVRSGALRGGLLVDDFRTRGSGRKQPGNPKPRERRTESPPVFTWTSHHRASNHSPGGSRLLELQEEKLSNYRMEMKPLLRMETHPQKRRYSKGGACRGLGDDHRPEDRGFGVQRLRSKAQNKENFRPASSAEPAVQKLASLRLGGAEPRLLRWDLTFSPPQKSLPVALESDEENGDELKSSTGSAPILVVMVILLNIGVAILFINFFI

SEQ ID NO: 802043 - protein, 150 aa, Homo sapiens; identical to SEQ ID NO: 802041

SEQ ID NO: 802044 - protein, 187 aa, Homo sapiens
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGDATAFGAEPGPEARELPAAAAAAAAAAAAAAVRWFLCREPWPALQLPACLDSPISTPQCT

SEQ ID NO: 802045 - protein, 37 aa, Homo sapiens
MGSIKQPRVQPRNRRLGPPRGWPPEPEKVGPLGSVPP

SEQ ID NO: 802046 - protein, 748 aa, Homo sapiens; identical to SEQ ID NO: 802042

SEQ ID NO: 802047 - protein, 748 aa, Homo sapiens; identical to SEQ ID NO: 802042

SEQ ID NO: 802048 - protein, 335 aa, Homo sapiens
SLPGSPAPSQRCFKPYPLITPCYIKTTTRQLSSPNHSPSQSPNQSPRIKRRPEPSLSRGSRTALASVAAPAKKHRADGGLAAGLSRSADWTEELGARTPRVGGSAHLLERGVASDSGGGVSPALAAKASGAPAAADGFQNVFTGRTLLEKLFSQQENGPPEEAEKFCSRIIAMGLLLPFSDCFREPCNQNAQTNAASFDQDQLYTWAAVSQPTHSLDYSEGQFPRRVPSMGPPSKPPDEEHRLEDAETESQSAVSETPQKRSDAVQKEVVDMKSEGQATVIQQLEQTIEDLRTKIAELERQYPALDTEVASGHQGLENGVTASGDVCLEALRLEE

SEQ ID NO: 802049 - protein, 99 aa, Homo sapiens
VQQVEEARGFLADEMDAADIVCVADVVPRDPLALIFLLQGWRGVEIDRRYAVQASLDLLASSDPPASVSRVAEITGGNVDMAWHSEIPGKTFSYLSSFS

SEQ ID NO: 802050 - protein, 131 aa, Homo sapiens
VQQVEEARGFLADEMDAADIVCVADVVPRDPLALIFLLQGWRGVEIDRRYAVQASLDLLASSDPPASVSRVAEITVEMRFCHVSQSDLELLTSGHPPTLASQSTGITGGNVDMAWHSEIPGKTFSYLSSFS

SEQ ID NO: 802051 - protein, 419 aa, Homo sapiens
MGEKKPEPLDFVKDFQEYLTQQTHHVNMISGSVSGDKEAEALQGAGTDGDQNGLDHPSVEVSLDENSGMLVDGFERTFDGKLKCRYCNYASKGTARLIEHIRIHTGEKPHRCHLCPFASAYERHLEAHMRSHTGEKPYKCELCSFRCSDRSNLSHHRRRKHKMVPIKGTRSSLSSKKMWGVLQKKTSNLGYSRRALINLSPPSMVVQKPDYLNDFTHEIPNIQTDSYESMAKTTPTGGLPRDPQELMVDNPLNQLSTLAGQLSSLPPENQNPASPDVVPCPDEKPFMIQQPSTQAVVSAVSASIPQSSSPTSPEPRPSHSQRNYSPVAGPSSEPSAHTSTPSIGNSQPSTPAPALPVQDPQLLHHCQHCDMYFADNILYTIHMGCHGYENPFQCNICGCKCKNKYDFACHFARGQHNQH

SEQ ID NO: 802052 - protein, 419 aa, Homo sapiens; identical to SEQ ID NO: 802051

SEQ ID NO: 802053 - protein, 419 aa, Homo sapiens; identical to SEQ ID NO: 802051

SEQ ID NO: 802054 - protein, 488 aa, Homo sapiens
MTLSGGGSASDMSGQTVLTAEDVDIDVVGEGDDGLEEKDSDAGCDSPAGPPELRLDEADEVPPAAPHHGQPQPPHQQPLTLPKEAAGAGAGPGGDVGAPEADGCKGGVGGEEGGASGGGPGAGSGSAGGLAPSKPKNSLVKPPYSYIALITMAILQSPQKKLTLSGICEFISNRFPYYREKFPAWQNSIRHNLSLNDCFVKIPREPGNPGKGNYWTLDPQSEDMFDNGSFLRRRKRFKRHQQEHLREQTALMMQSFGAYSLAAAAGAAGPYGRPYGLHPAAAAGAYSHPAAAAAAAAAAALQYPYALPPVAPVLPPAVPLLPSGELGRKAAAFGSQLGPGLQLQLNSLGAAAAAAGTAGAAGTTASLIKSEPSARPSFSIENIIGGGPAAPGGSAVGAGVAGGTGGSGGGSTAQSFLRPPGTVQSAALMATPLKPNGRRNRDAPMAGTQGPAAASSNKCTSRLRALSQARSRSRCPILDSASPQFPFP

SEQ ID NO: 802055 - protein, 478 aa, Homo sapiens
MTLSGGGSASDMSGQTVLTAEDVDIDVVGEGDDGLEEKDSDAGCDSPAGPPELRLDEADEVPPAAPHHGQPQPPHQQPLTLPKEAAGAGAGPGGDVGAPEADGCKGGVGGEEGGASGGGPGAGSGSAGGLAPSKPKNSLVKPPYSYIALITMAILQSPQKKLTLSGICEFISNRFPYYREKFPAWQNSIRHNLSLNDCFVKIPREPGNPGKGNYWTLDPQSEDMFDNGSFLRRRKRFKRHQQEHLREQTALMMQSFGAYSLAAAAGAAGPYGRPYGLHPAAAAGAYSHPAAAAAAAAAAALQYPYALPPVAPVLPPAVPLLPSGELGRKAAAFGSQLGPGLQLQLNSLGAAAAAAGTAGAAGTTASLIKSEPSARPSFSIENIIGGGPAAPGGSAVGAGVAGGTGGSGGGSTAQSFLRPPGTVQSAALMATHQPLSLSRTTATIAPILSVPLSGQFLQPAASAAAAAAAAAQAKWPAQ

SEQ ID NO: 802056 - protein, 108 aa, Homo sapiens
MALKFYWVRDLLSSRHSSIEYSSNYSREIGDYSNSIYSIVILTRYRLLLLLLLKFQQKKITAASKNAPAQKVPAQKTGQKAAPAPKAQKGQKAPAQKAPAPKASGKKA

SEQ ID NO: 802057 - protein, 1228 aa, Homo sapiens
AGQLQRSRGAGGGAQAVRLGSAECEAWRAAARSDGPGAATPRGRPAARRAGDLPLHAPCALQLAGGTMKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 802058 - protein, 745 aa, Homo sapiens
MALKFYWVRDLLSSRHSSIEYSSNYSREIGDYSNSIYSIVILTSQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 802059 - protein, 625 aa, Homo sapiens [sequence omitted]

SEQ ID NO: 802060 - protein, 759 aa, Homo sapiens
AGQLQRSRGAGGGAQAVRLGSAECEAWRAAARSDGPGAATPRGRPAARRAGDLPLHAPCALQLAGGTMKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGKLHM

SEQ ID NO: 802061 - protein, 726 aa, Homo sapiens
AGQLQRSRGAGGGAQAVRLGSAECEAWRAAARSDGPGAATPRGRPAARRAGDLPLHAPCALQLAGGTMKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINKCCKQLLRHGALLTENSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSSKGHLKAYFASQ

SEQ ID NO: 802062 - protein, 1228 aa, Homo sapiens; identical to SEQ ID NO: 802057

SEQ ID NO: 802063 - protein, 865 aa, Homo sapiens
MLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 802064 - protein, 759 aa, Homo sapiens; identical to SEQ ID NO: 802060

SEQ ID NO: 802065 - protein, 233 aa, Homo sapiens
SGRRDSCLPGVVAPRACLHPRGQVPRLGSVGKMATPGMSWQQHYYGGSAAKFAPSPATAQLAGHSMDYSQEMHLKMSKKIAQLTKVIYALNTKNDEHESAIQALKDAHEEEIQQILAETREKILQYKSKVTEELDLRRKIQVLESSLEDHIKMKQQALTEFEAYKHRVEDMQLCAEAQHVQRIVTMSREVEEIRRKFEEKLRSFGQLQVQFEKDKRLALEDLQAAHRREIQEL

SEQ ID NO: 802066 - protein, 147 aa, Homo sapiens
RPPRLLPPGRRCSTGLPPPAGTGAPAGVCWEDGDPGHELAAALLRRLGGQIRALAGHRTAGWAQHGLQPGDAPENEQENRPAHQGKGGSDGAGGDPVRAAPDSPVSPGGSAPCARSEGNSTPPPKQQPETPPKPCKLWWNAGNMNLS

SEQ ID NO: 802067 - protein, 193 aa, Homo sapiens
SRTCYPLQHEEDKKSAMSQLLQLKDREKNAARDSWQKKVEDLLNQVIYALNTKNDEHESAIQALKDAHEEEIQQILAETREKILQYKSKVTEELDLRRKIQVLESSLEDHIKMKQQALTEFEAYKHRVEDMQLCAEAQHVQRIVTMSREVEEIRRKFEEKLRSFGQLQVQFEKDKRLALEDLQAAHRREIQEL

SEQ ID NO: 802068 - protein, 629 aa, Homo sapiens
AEQTRPGGELGAAGSSCLPQDSSCREPQGLWAARSWGHSPESVAMVCREQLSKNQVKWVFAGITCVSVVVIAAIVLAITLRRPGCELEACSPDADMLDYLLSLGQISRRDALEVTWYHAANSKKAMTAALNSNITVLEADVNVEGLGTANETGVPIMAHPPTIYSDNTLEQWLDAVLGSSQKGIKLDFKNIKAVGPSLDLLRQLTEEGKVRRPIWINADILKGPNMLISTEVNATQFLALVQEKYPKATLSPGWTTFYMSTSPNRTYTQAMVEKMHELVGGVPQRVTFPVRSSMVRAAWPHFSWLLSQSERYSLTLWQAASDPMSVEDLLYVRDNTAVHQVYYDIFEPLLSQFKQLALNATRKPMYYTGGSLIPLLQLPGDDGLNVEWLVPDVQGSGKTATMTLPDTEGMILLNTGLEGTVAENPVPIVHTPSGNILTLESCLQQLATHPGHWGIHLQIAEPAALRPSLALLARLSSLGLLHWPVWVGAKISHGSFSVPGHVAGRELLTAVAEVFPHVTVAPGWPEEVLGSGYREQLLTDMLELCQGLWQPVSFQMQAMLLGHSTAGAIGRLLASSPRATVTVEHNPAGGDYASVRTALLAARAVDRTRVYYRLPQGYHKDLLAHVGRN

SEQ ID NO: 802069 - protein, 186 aa, Homo sapiens
NVRLVRPEFMDSREPWRRVGGRMESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 802070 - protein, 183 aa, Homo sapiens
RFPRQLQCPREPWRRVGGRMESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 802071 - protein, 266 aa, Homo sapiens
RFPRQLQCPREPWRRVGGRMESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAVSRRGVPSCPRVDGLGSTIAQTEPGGFYWVVCGKRSSLTTLPSMSRSGYSEQLGPSSGMGASLPPCLTSPTVEATPVADSRTGARGLRTRA

SEQ ID NO: 802072 - protein, 268 aa, Homo sapiens
KQAGTAWGLRSREPWRRVGGRMESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAVSRRGVPSCPRVDGLGSTIAQTEPGGFYWVVCGKRSSLTTLPSMSRSGYSEQLGPSSGMGASLPPCLTSPTVEATPVADSRTGARGLRTRA

SEQ ID NO: 802073 - protein, 184 aa, Homo sapiens
DAWATHASGPREPWRRVGGRMESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 802074 - protein, 183 aa, Homo sapiens; identical to SEQ ID NO: 802070

SEQ ID NO: 802075 - protein, 186 aa, Homo sapiens; identical to SEQ ID NO: 802069

SEQ ID NO: 802076 - protein, 239 aa, Homo sapiens
RFPRQLQCPREPWRRVGGRMESGDEAAIERHRVHLRSATLRDAVPATLHLLPCEVAVDGPAPVGRFFTPAIRQGPEGEPAAGLRLPAAPAPACALLIAWAPGDRGPSGGGGRAAPGSTQRGSCLRPFAPPAPGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 802077 - protein, 183 aa, Homo sapiens; identical to SEQ ID NO: 802070

SEQ ID NO: 802078 - protein, 183 aa, Homo sapiens; identical to SEQ ID NO: 802070

SEQ ID NO: 802079 - protein, 239 aa, Homo sapiens; identical to SEQ ID NO: 802076

SEQ ID NO: 802080 - protein, 271 aa, Homo sapiens
RFPRQLQCPREPWRRVGGRMESGDEAAIERHRVHLRSATLRDAVPATLHLLPCEVAVDGPAPVGRFFTPAIRQGPEGEPAAGLRLPAAPAPACALLIAWAPGDRGPSGGGGRAAPGSTQRGSCLRPFAPPAPGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAANDLCLSQRPPLCIHAYSSEHHCKKSPQPLCHPPRLKGNPL

SEQ ID NO: 802081 - protein, 960 aa, Homo sapiens
MATEPRGGAGPSEPEHPATNPPGAAPPACADSDPGASEPGLLARRGSGSALGGPLDPQFVGPSDTSLGAAPGHRVLPCGPSPQHHRALRFSYHLEGSQPRPGLHQGNRILVKSLSLDPGQSLEPHPEGPQRLRSDPGPPTETPSQRPSPLKRAPGPKPQVPPKPSYLQMPRMPPPLEPIPPPPSRPLPADPRVAKGLAPRAEASPSSAAVSSLIEKFEREPVIVASDRPVPGPSPGPPEPVMLPQPTSQPPVPQLPEGEASRCLFLLAPGPRDGEKVPNRDSGIDSISSPSNSEETCFVSDDGPPSHSLCPGPPALASVPVALADPHRPGSQEVDSDLEEEDDEEEEEEKDREIPVPLMERQESVELTVQQKVFHIANELLQTEKAYVSRLHLLDQVFCARLLEEARNRSSFPADVVHGIFSNICSIYCFHQQFLLPELEKRMEEWDRYPRIGDILQKLAPFLKMYGEYVKNFDRAVELVNTWTERSTQFKVIIHEVQKEEACGNLTLQHHMLEPVQRIPRYELLLKDYLLKLPHGSPDSKDAQKSLELIATAAEHSNAAIRKMERMHKLLKVYELLGGEEDIVSPTKELIKEGHILKLSAKNGTTQDRYLILFNDRLLYCVPRLRLLGQKFSVRARIDVDGMELKESSNLNLPRTFLVSGKQRSLELQARTEEEKKDWVQAINSTLLKHEQTLETFKLLNSTNREDEDTPPNSPNVDLGKRAPTPIREKEVTMCMRCQEPFNSITKRRHHCKACGHVVCGKCSEFRARLVYDNNRSNRVCTDCYVALHGVPGSSPACSQHTPQRRRSILEKQASVAAENSVICSFLHYMEKGGKGWHKAWFVVPENEPLVLYIYGAPQDVKAQRSLPLIGFEVGPPEAGERPDRRHVFKITQSHLSWYFSPETEELQRRWMAVLGRAGRGDTFCPGPTLSEDREMEEAPVAALGATAEPPESPQTRDKT

SEQ ID NO: 802082 - protein, 73 aa, Homo sapiens
EPAEQKELSQQAEDGSTANGRRMGPGPAIALGLTKVSRLHNSWLSRQNQTMSIPDGVCTAFLPHPHTPLKPQC

SEQ ID NO: 802083 - protein, 611 aa, Homo sapiens
ASCNPEAMPFGEKEPVELTVQQKVFHIANELLQTEKAYVSRLHLLDQVFCARLLEEARNRSSFPADVVHGIFSNICSIYCFHQQFLLPELEKRMEEWDRYPRIGDILQKLAPFLKMYGEYVKNFDRAVELVNTWTERSTQFKVIIHEVQKEEACGNLTLQHHMLEPVQRIPRYELLLKDYLLKLPHGSPDSKDAQKSLELIATAAEHSNAAIRKMERMHKLLKVYELLGGEEDIVSPTKELIKEGHILKLSAKNGTTQDRYLILFNDRLLYCVPRLRLLGQKFSVRARIDVDGMELKESSNLNLPRTFLVSGKQRSLELQARTEEEKKDWVQAINSTLLKHEQTLETFKLLNSTNREDEDTPPNSPNVDLGKRAPTPIREKEVTMCMRCQEPFNSITKRRHHCKACGHVVCGKCSEFRARLVYDNNRSNRVCTDCYVALHGVPGSSPACSQHTPQRRRSILEKQASVAAENSVICSFLHYMEKGGKGWHKAWFVVPENEPLVLYIYGAPQDVKAQRSLPLIGFEVGPPEAGERPDRRHVFKITQSHLSWYFSPETEELQRRWMAVLGRAGRGDTFCPGPTLSEDREMEEAPVAALGATAEPPESPQTRDKT

SEQ ID NO: 802084 - protein, 960 aa, Homo sapiens; identical to SEQ ID NO: 802081

SEQ ID NO: 802085 - protein, 960 aa, Homo sapiens; identical to SEQ ID NO: 802081

SEQ ID NO: 802086 - protein, 888 aa, Homo sapiens
MATEPRGGAGPSEPEHPATNPPGAAPPACADSDPGASEPGLLARRGSGSALGGPLDPQFVGPSDTSLGAAPGHRVLPCGPSPQHHRALRFSYHLEGSQPRPGLHQGNRILVKSLSLDPGQSLEPHPEGPQRLRSDPGPPTETPSQRPSPLKRAPGPKPQVPPKPSYLQMPRMPPPLEPIPPPPSRPLPADPRVAKGLAPRAEASPSSAAVSSLIEKFEREPVIVASDRPVPGPSPGPPEPVMLPQPTSQPPVPQLPEGEASRCLFLLAPGPRDGEKVPNRDSGIDSISSPSNSEETCFVSDDGPPSHSLCPGPPALASVPVALADPHRPGSQEVDSDLEEEDDEEEEEEKDREIPVPLMERQESVELTVQQKVFHIANELLQTEKAYVSRLHLLDQVFCARLLEEARNRSSFPADVVHGIFSNICSIYCFHQQFLLPELEKRMEEWDRYPRIGDILQKLAPFLKMYGEYVKNFDRAVELVNTWTERSTQFKVIIHEVQKEEACGNLTLQHHMLEPVQRIPRYELLLKDYLLKLPHGSPDSKDAQKSLELIATAAEHSNAAIRKMERMHKLLKVYELLGGEEDIVSPTKELIKEGHILKLSAKNGTTQDRYLILFNDRLLYCVPRLRLLGQKFSVRARIDVDGMELKESSNLNLPRTFLVSGKQRSLELQARTEEEKKDWVQAINSTLLKHEQTLETFKLLNSTNREDEDTPPNSPNVDLGKRAPTPIREKEVTMCMRCQEPFNSITKRRHHCKACGHVVCGKCSEFRARLVYDNNRSNRVCTDCYVALHGVPGSSPACSQHTPQRRRSILEKQASVAAENSVICSFLHYMEKGGKGWHKAWFVVPENEPLVLYIYGAPQVCILLLRVLSATWQSQIQSLTSPWPWKIR

SEQ ID NO: 802087 - protein, 414 aa, Homo sapiens
MATEPRGGAGPSEPEHPATNPPGAAPPACADSDPGASEPGLLARRGSGSALGGPLDPQFVGPSDTSLGAAPGHRVLPCGPSPQHHRALRFSYHLEGSQPRPGLHQGNRILVKSLSLDPGQSLEPHPEGPQRLRSDPGPPTETPSQRPSPLKRAPGPKPQVPPKPSYLQMPRMPPPLEPIPPPPSRPLPADPRVAKGLAPRAEASPSSAAVSSLIEKFEREPVIVASDRPVPGPSPGPPEPVMLPQPTSQPPVPQLPEGEASRCLFLLAPGPRDGEKVPNRDSGIDSISSPSNSEETCFVSDDGPPSHSLCPGPPALASVPVALADPHRPGSQEVDSDLEEEDDEEEEEEKDREIPWLTASTRPQGYPVFYRPDPWQGQRAGQGNRGEDNGYSVFCVFLCVFFFLRKIQFISGLQ

SEQ ID NO: 802088 - protein, 99 aa, Homo sapiens
KVVKLEGADLGRRGLQGCGGASAARSEPLCFCLSQKEEACGNLTLQHHMLEPVQRIPRYELLLKDYLLKLPHGSPDSKDAQSECVHPGPFLLLHTNSSR

SEQ ID NO: 802089 - protein, 763 aa, Homo sapiens
VVTGIVVLQKSGNRPEDLRAAQLPGRLELLLNNFCSAMSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGSGSEGEDGFQVELELVELTVGTLDLCESEVLPKRRRRKRNKKEKSRDQEAGAHRTLLQQTQEEEPSTQSSQAVAAPLGPLLDEAKAPGQPELWNALLAACRAGDVGVLKLQLAPSPADPRVLSLLSAPLGSGGFTLLHAAAAAGRGSVVRLLLEAGADPTVQDSRARPPYTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 802090 - protein, 189 aa, Homo sapiens
LLCISHSEYNSCHCGFGLPFYVQFLFPYLGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQASDSTGCMANPNLLYTQPRFPLA

SEQ ID NO: 802091 - protein, 766 aa, Homo sapiens
VIAVEAGLNGRGKSGNRPEDLRAAQLPGRLELLLNNFCSAMSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGSGSEGEDGFQVELELVELTVGTLDLCESEVLPKRRRRKRNKKEKSRDQEAGAHRTLLQQTQEEEPSTQSSQAVAAPLGPLLDEAKAPGQPELWNALLAACRAGDVGVLKLQLAPSPADPRVLSLLSAPLGSGGFTLLHAAAAAGRGSVVRLLLEAGADPTVQDSRARPPYTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 802092 - protein, 463 aa, Homo sapiens
VVTGIVVLQKSGNRPEDLRAAQLPGRLELLLNNFCSAMSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGLITIWQLSDLSFCPKNALANSLLS

SEQ ID NO: 802093 - protein, 463 aa, Homo sapiens; identical to SEQ ID NO: 802092

SEQ ID NO: 802094 - protein, 463 aa, Homo sapiens; identical to SEQ ID NO: 802092

SEQ ID NO: 802095 - protein, 463 aa, Homo sapiens; identical to SEQ ID NO: 802092

SEQ ID NO: 802096 - protein, 361 aa, Homo sapiens [sequence omitted]

SEQ ID NO: 802097 - protein, 410 aa, Homo sapiens
VIAVEAGLNGRGKSGNRPEDLRAAQLPGRLELLLNNFCSAMSPAPDAAPAPASISLFDLSADAPVFQGLSLREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGLITIWQLSDLSFCPKNALANSLLS

SEQ ID NO: 802098 - protein, 308 aa, Homo sapiens
GPYYYYISGRRSEVLPKRRRRKRNKKEKSRDQEAGAHRTLLQQTQEEEPSTQSSQAVAAPLGPLLDEAKAPGQPELWNALLAACRAGDVGVLKLQLAPSPADPRVLSLLSAPLGSGGFTLLHAAAAAGRGSVVRLLLEAGADPTVQDSRARPPYTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 802099 - protein, 261 aa, Homo sapiens
VVTGIVVLQKSGNRPEDLRAAQLPGRLELLLNNFCSAMSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQG

SEQ ID NO: 802100 - protein, 726 aa, Homo sapiens
MSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGSGSEGEDGFQVELELVELTVGTLDLCESEVLPKRRRRKRNKKEKSRDQEAGAHRTLLQQTQEEEPSTQSSQAVAAPLGPLLDEAKAPGQPELWNALLAACRAGDVGVLKLQLAPSPADPRVLSLLSAPLGSGGFTLLHAAAAAGRGSVVRLLLEAGADPTVQDSRARPPYTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 802101 - protein, 463 aa, Homo sapiens; identical to SEQ ID NO: 802092

SEQ ID NO: 802102 - protein, 463 aa, Homo sapiens; identical to SEQ ID NO: 802092

SEQ ID NO: 802103 - protein, 463 aa, Homo sapiens; identical to SEQ ID NO: 802092

SEQ ID NO: 802104 - protein, 366 aa, Homo sapiens [sequence omitted]

SEQ ID NO: 802105 - protein, 164 aa, Homo sapiens
PPEIGINTPKTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 802106 - protein, 208 aa, Homo sapiens
VIAVEAGLNGRGKSGNRPEDLRAAQLPGRLELLLNNFCSAMSPAPDAAPAPASISLFDLSADAPVFQGLSLREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQG

SEQ ID NO: 802107 - protein, 530 aa, Homo sapiens
HLAHLSFFLLFFRTLGGKRERVGQMPAAAVQEAVGVCSYGMQLSWDINDPQMPQELALFDQFREWPDGYVRFIYSSDEKKAQRHLSGWAMRNTNNHNGHILKKSCLGVVVCTQACTLPDGSRLQLRPAICDKARLKQQKKACPNCHSALELIPCRGHSGYPVTNFWRLDGNAIFFQAKGVHDHPRPESKSETEARRSAIKRQMASFYQPQKKRIRESEAEENQDSSGHFSNIPPLENPEDFDIVTETSFPIPGQPCPSFPKSDVYKATCDLATFQGDKMPPFQKYSSPRIYLPRPPCSYELANPGYTNSSPYPTLYKDSTSIPNDTDWVHLNTLQCNVNSYSSYERSFDFTNKQHGWKPALGKPSLVERTNHGQFQAMATRPYYNPELPCRYLTTPPPGAPALQTVITTTTKVSYQAYQPPAMKYSDSVREVKSLSSCNYAPEDTGMSVYPEPWGPPVTVTRAASPSGPPPMKIAGDCRAIRPTVAIPHEPVSSRTDEAETWDVCLSGLGSAVSYSDRVGPFFTYNNEDF

SEQ ID NO: 802108 - protein, 112 aa, Homo sapiens
MFRVLCHCIDFIDFHSANLGMCALGRGGCQNPVIAGTGWGTILRRRGLDPPPPNRRTTSQAPRSLRKLRGRKGTGPQSPGLQSRPSLPPVPCSAPRVRVCPPQAPTVNTIPV

SEQ ID NO: 802109 - protein, 112 aa, Homo sapiens; identical to SEQ ID NO: 802108

SEQ ID NO: 802110 - protein, 112 aa, Homo sapiens; identical to SEQ ID NO: 802108

SEQ ID NO: 802111 - protein, 112 aa, Homo sapiens; identical to SEQ ID NO: 802108

SEQ ID NO: 802112 - protein, 112 aa, Homo sapiens; identical to SEQ ID NO: 802108

SEQ ID NO: 802113 - protein, 480 aa, Homo sapiens
VTREVEFAQTSNMARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQR

SEQ ID NO: 802114 - protein, 540 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNSKGLPSSSTFTLEEGTIYLTAEPNTLEVQDDNASVLDVYL

SEQ ID NO: 802115 - protein, 540 aa, Homo sapiens; identical to SEQ ID NO: 802114

SEQ ID NO: 802116 - protein, 540 aa, Homo sapiens; identical to SEQ ID NO: 802114

SEQ ID NO: 802117 - protein, 540 aa, Homo sapiens; identical to SEQ ID NO: 802114

SEQ ID NO: 802118 - protein, 384 aa, Homo sapiens [sequence omitted]

SEQ ID NO: 802119 - protein, 540 aa, Homo sapiens; identical to SEQ ID NO: 802114

SEQ ID NO: 802120 - protein, 134 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLMRNLKLGSAKGDAQGYTHWWGQSLDQTV

SEQ ID NO: 802121 - protein, 540 aa, Homo sapiens; identical to SEQ ID NO: 802114

SEQ ID NO: 802122 - protein, 540 aa, Homo sapiens; identical to SEQ ID NO: 802114

SEQ ID NO: 802123 - protein, 540 aa, Homo sapiens; identical to SEQ ID NO: 802114

SEQ ID NO: 802124 - protein, 502 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNSK

SEQ ID NO: 802125 - protein, 501 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNR

SEQ ID NO: 802126 - protein, 197 aa, Homo sapiens
RRRCVPVEARAAGVFGDRLAGVFGSRGLKHGGVQAPRPRVVRAEPRAGFAVVRSPRRLCGRSHAPQPPAHLGLGPGCFPAVAVVVPVPGSRAHRPCELGLFFLLRVAHSSLGCFLAAQTCSGRLEKATPGLQLSPEGLPLGLRLGPWNPPSVSSAVPLLASIWVVAWILWLAASLLLRITALHCLSSGAWKPLYFLV

SEQ ID NO: 802127 - protein, 179 aa, Homo sapiens
RRRCVPVEARAAGVFGDRLAGVFGSRGLKHGGVQAPRPRVVRAEPRAGFAVVRSPRRLCGRSHAPQPPAHLGLGPGCFPAVAVVVPVPGSRAHRPFAALLVEGSFLGDPPIPPRRSGVLARGSAGADCLASSVTPGPSLWIPLLLVAGCVSCFVGLAVCVWMQARVSPAWPAGLFLLPR

SEQ ID NO: 802128 - protein, 317 aa, Homo sapiens
GASWFTPPSAETDPRSGPRTLCREGKYWTLKWARTETKRPQHASGFEWRGHSLCWDREQRDVESLKMLLDNGLRLGQWQEIPFTQDLQDKRSAWQLHVFFFQTGCQVGMNDDIRDSDLPDWRDRTPWCLEISWTTVSSQSCSPLLTSPGLRIDNITLLDPSSVQKKAMDRTETRFRKRGQITGKITTSRQPHRQNEQSPQRSTSGYPLQEVVDDEVLGPSAPGVDPSPPHRSFCWKRKMEWWDKSEESEEEPRKVLAPEPEEIWVAEMLCGLKMKLKRRRVSLVLPEHHEAFNRLLGRRTPQRAPPILFFPKTGNFQ

SEQ ID NO: 802129 - protein, 389 aa, Homo sapiens
TIFPSLTPFQKAVESRHQNVGRACFPFLKTRSCSSTHPLLGSPEMGRAGVMTNLIIRMRRNLGPGRERNFLQSQGRSAAGWKRKREWSDESEEEPEKELAPEPEETWVVETLCGLKMKLKQQRVSPILLEHHKDFNSQLAPGVDPSPPHRSFCWKRKMEWWDKSEESEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRLHFFLALYLANDMEEDDEDSKQNIFHFLYGKNRSRIPLLRKRRFQLYRSMNPRARKNRSHIPLVRKRRFQLRRCMNPRARKNRSQIVLFQKRRFHFFCSMSCRAWVSPEELEEIQAYDPEHWVWARDRARLS

SEQ ID NO: 802130 - protein, 269 aa, Homo sapiens
GTLAPGWRLVKGFLNQPVDVELYQGLWDMCREQSSRERECGQTDQWGYFEAQPVLVARALMVTSLAATVLGLLLASLGVRCWQDEPNFVLAGLSGVVLFVAGLLGLIPVSWYNHFLGDRDVLPAPASPVTVQVSYSLVLGYLGSCLLLLGGFSLALSFAPWCDERCRRRRKGPSAGPRRSSVSTIQVEWPEPDLAPAIKYYSDGQHRPPPAQHRKPKTKPKVGFPMPRPRPKAYTNSVDVLDGEGWESQDAPSCSTHPCDSSLPCDSDL

SEQ ID NO: 802131 - protein, 269 aa, Homo sapiens; identical to SEQ ID NO: 802130

SEQ ID NO: 802132 - protein, 687 aa, Homo sapiens
EGAGMRRCPCRGSLNEAEAGALPAAARMGLEAPRGGRRRQPGQQRPGPGAGAPAGRPEGGGPWARTEGSSLHSEPERAGLGPAPGTESPQAEFWTDGQTEPAAAGLGVETERPKQKTEPDRSSLRTHLEWSWSELETTCLWTETGTDGLWTDPHRSDLQFQPEEASPWTQPGVHGPWTELETHGSQTQPERVKSWADNLWTHQNSSSLQTHPEGACPSKEPSADGSWKELYTDGSRTQQDIEGPWTEPYTDGSQKKQDTEAARKQPGTGGFQIQQDTDGSWTQPSTDGSQTAPGTDCLLGEPEDGPLEEPEPGELLTHLYSHLKCSPLCPVPRLIITPETPEPEAQPVGPPSRVEGGSGGFSSASSFDESEDDVVAGGGGASDPEDRSGSKPWKKLKTVLKYSPFVVSFRKHYPWVQLSGHAGNFQAGEDGRILKRFCQCEQRSLEQLMKDPLRPFVPAYYGMVLQDGQTFNQMEDLLADFEGPSIMDCKMGSRTYLEEELVKARERPRPRKDMYEKMVAVDPGAPTPEEHAQGAVTKPRYMQWRETMSSTSTLGFRIEGIKKADGTCNTNFKKTQALEQVTKVLEDFVDGDHVILQKYVACLEELREALEISPFFKTHEVVGSSLLFVHDHTGLAKVWMIDFGKTVALPDHQTLSHRLPWAEGNREDGYLWGLDNMICLLQGLAQS

SEQ ID NO: 802133 - protein, 535 aa, Homo sapiens
APTTPKRNTAGQAPVRMRAWVHGPWTELETHGSQTQPERVKSWADNLWTHQNSSSLQTHPEGACPSKEPSADGSWKELYTDGSRTQQDIEGPWTEPYTDGSQKKQDTEAARKQPGTGGFQIQQDTDGSWTQPSTDGSQTAPGTDCLLGEPEDGPLEEPEPGELLTHLYSHLKCSPLCPVPRLIITPETPEPEAQPVGPPSRVEGGSGGFSSASSFDESEDDVVAGGGGASDPEDRSGSKPWKKLKTVLKYSPFVVSFRKHYPWVQLSGHAGNFQAGEDGRILKRFCQCEQRSLEQLMKDPLRPFVPAYYGMVLQDGQTFNQMEDLLADFEGPSIMDCKMGSRTYLEEELVKARERPRPRKDMYEKMVAVDPGAPTPEEHAQGAVTKPRYMQWRETMSSTSTLGFRIEGIKKADGTCNTNFKKTQALEQVTKVLEDFVDGDHVILQKYVACLEELREALEISPFFKTHEVVGSSLLFVHDHTGLAKVWMIDFGKTVALPDHQTLSHRLPWAEGNREDGYLWGLDNMICLLQGLAQS

SEQ ID NO: 802134 - protein, 687 aa, Homo sapiens; identical to SEQ ID NO: 802132

SEQ ID NO: 802135 - protein, 174 aa, Homo sapiens [sequence omitted]

SEQ ID NO: 802136 - protein, 597 aa, Homo sapiens
EGAGMRRCPCRGSLNEAEAGALPAAARMGLEAPRGGRRRQPGQQRPGPGAGAPAGRPEGGGPWARTEGSSLHSEPERAGLGPAPGTESPQAEFWTDGQTEPAAAGLGVETERPKQKTEPDRSSLRTHLEWSWSELETTCLWTETGTDGLWTDPHRSDLQFQPEEASPWTQPGVHGPWTELETHGSQTQPERVKSWADNLWTHQNSSSLQTHPEGACPSKEPSADGSWKELYTDGSRTQQDIEGPWTEPYTDGSQKKQDTEAARKQPGTGGFQIQQDTDGSWTQPSTDGSQTAPGTDCLLGEPEDGPLEEPEPGELLTHLYSHLKCSPLCPVPRLIITPETPEPEAQPVGPPSRVEGGSGGFSSASSFDESEDDVVAGGGGASDPEDRSGSKPWKKLKTVLKYSPFVVSFRKHYPWVQLSGHAGNFQAGEDGRILKRFCQCEQRSLEQLMKDPLRPFVPAYYGMVLQDGQTFNQMEDLLADFEGPSIMDCKMGSRTYLEEELVKARERPRPRKDMYEKMVAVDPGAPTPEEHAQGAVTKPRYMQWRETMSSTSTLGFRIEGIKVRTRNRLACPGKAYSQIPGRASWGKPRESAGDGVG

SEQ ID NO: 802137 - protein, 399 aa, Homo sapiens
EGAGMRRCPCRGSLNEAEAGALPAAARMGLEAPRGGRRRQPGQQRPGPGAGAPAGRPEGGGPWARTEGSSLHSEPERAGLGPAPGTESPQAEFWTDGQTEPAAAGLGVETERPKQKTEPDRSSLRTHLEWSWSELETTCLWTETGTDGLWTDPHRSDLQFQPEEASPWTQPGVHGPWTELETHGSQTQPERVKSWADNLWTHQNSSSLQTHPEGACPSKEPSADGSWKELYTDGSRTQQDIEGPWTEPYTDGSQKKQDTEAARKQPGTGGFQIQQDTDGSWTQPSTDGSQTAPGTDCLLGEPEDGPLEEPEPGELLTHLYSHLKCSPLCPVPRLIITPETPEPEAQPVGPPSRVEGGSGGFSSASSFDESEDDVVAGGGGASDPEDRSGVSGTHPALEP

SEQ ID NO: 802138 - protein, 111 aa, Homo sapiens
LGPRWVRWTYLEEELVKARERPRPRKDMYEKMVAVDPGAPTPEEHAQGAVTKPRYMQWRETMSSTSTLGFRIEGIKVRTRNRLACPGKAYSQIPGRASWGKPRESAGDGVG

SEQ ID NO: 802139 - protein, 687 aa, Homo sapiens; identical to SEQ ID NO: 802132

SEQ ID NO: 802140 - protein, 575 aa, Homo sapiens
EGAGMRRCPCRGSLNEAEAGALPAAARMGLEAPRGGRRRQPGQQRPGPGAGAPAGRPEGGGPWARTEGSSLHSEPERAGLGPAPGTESPQAEFWTDGQTEPAAAGLGVETERPKQKTEPDRSSLRTHLEWSWSELETTCLWTETGTDGLWTDPHRSDLQFQPEEASPWTQPGVHGPWTELETHGSQTQPERVKSWADNLWTHQNSSSLQTHPEGACPSKEPSADGSWKELYTDGSRTQQDIEGPWTEPYTDGSQKKQDTEAARKQPGTGGFQIQQDTDGSWTQPSTDGSQTAPGTDCLLGEPEDGPLEEPEPGELLTHLYSHLKCSPLCPVPRLIITPETPEPEAQPVGPPSRVEGGSGGFSSASSFDESEDDVVAGGGGASDPEDRSGSKPWKKLKTVLKYSPFVVSFRKHYPWVQLSGHAGNFQAGEDGRILKRFCQCEQRSLEQLMKDPLRPFVPAYYGMVLQDGQTFNQMEDLLADFEGPSIMDCKMGSRTYLEEELVKARERPRPRKDMYEKMVAVDPGAPTPEEHAQGAVTKPRYMQWRETMSSTSTLGFRIEGIKLCNTVFVTVPGPL

SEQ ID NO: 802141 - protein, 72 aa, Homo sapiens
AGPLSFPLMAAPLAPAFPGLGPDPTLLCSLQSKPWKKLKTVLKYSPFVVSFRKHYPWVQLSGHAGKWGGGGQ

SEQ ID NO: 802142 - protein, 802 aa, Homo sapiens
MFISGRRTADKWRAEERLQCPAGSARAALARCADGGAVGPFKCVFVGEMAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVNRTYCCGTYRAGPMRQISLVGAVDEEVGDYFPEFLDMLEESPFLKMTLPWGTLSSLRLQCRSQSDDGPIMWVRPGEQMIPTADMPKSPFKRRRSMNEIKNLQYLPRTSEPREVLFEDRTRAHADHVGQGFDWQSTAAVGVLKAVQFGEWSDQPRITKDVICFHAEDFTDVVQRLQLDLHEPPVSQCVQWVDEAKLNQMRREGIRYARIQLCDNDIYFIPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKVESRLDSDQQHNLQEHSTTSV

SEQ ID NO: 802143 - protein, 802 aa, Homo sapiens; identical to SEQ ID NO: 802142

SEQ ID NO: 802144 - protein, 799 aa, Homo sapiens
MFISGRRTADKWRAEERLQCPAGSARAALARCADGGAVGPFKCVFVGEMAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVNRTYCCGTYRAGPMRQISLVGAVDEEVGDYFPEFLDMLEESPFLKMTLPWGTLSSLRLQCRSQSDDGPIMWVRPGEQMIPTADMPKSPFKRRRSMNEIKNLQYLPRTSEPREVLFEDRTRAHADHVGQGFDWQSTAAVGVLKAVQFGEWSDQPRITKDVICFHAEDFTDVVQRLQLDLHEPPVSQCVQWVDEAKLNQMRREGIRYARIQLCDNDIYFIPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKHFCVICTYSNTFFNFFKF

SEQ ID NO: 802145 - protein, 129 aa, Homo sapiens
MNLQFPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKVESRLDSDQQHNLQEHSTTSV

SEQ ID NO: 802146 - protein, 802 aa, Homo sapiens; identical to SEQ ID NO: 802142

SEQ ID NO: 802147 - protein, 485 aa, Homo sapiens
MFISGRRTADKWRAEERLQCPAGSARAALARCADGGAVGPFKCVFVGEMAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVKRDILGGAPTGPGLMRKKNFFGTFI

SEQ ID NO: 802148 - protein, 221 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKGVLQAPTEGGMG

SEQ ID NO: 802149 - protein, 411 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGLACATARLYNQIISHT

SEQ ID NO: 802150 - protein, 306 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEV

SEQ ID NO: 802151 - protein, 532 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 802152 - protein, 399 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGKYKK

SEQ ID NO: 802153 - protein, 187 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKAVLDSTLSHHTSFPYKLFSQISTKTPYFTNDCVVLKWCSYSTGLLKVKNKPKN

SEQ ID NO: 802154 - protein, 532 aa, Homo sapiens; identical to SEQ ID NO: 802151

SEQ ID NO: 802155 - protein, 576 aa, Homo sapiens
RYRRFKLSKSPNLPNSFSWLVRAAKGGVELVNKKPAFIFLMQENMAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 802156 - protein, 208 aa, Homo sapiens
VRLPQPQGTTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEV

SEQ ID NO: 802157 - protein, 128 aa, Homo sapiens
MIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 802158 - protein, 532 aa, Homo sapiens; identical to SEQ ID NO: 802151

SEQ ID NO: 802159 - protein, 118 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKQTWSSTSLSLS

SEQ ID NO: 802160 - protein, 44 aa, Homo sapiens
MLEQVPALGETRLTLAAGEGPLPGVDPLVAGQEGRVAEVAATVW

SEQ ID NO: 802161 - protein, 204 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHGGLGE

SEQ ID NO: 802162 - protein, 425 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 802163 - protein, 425 aa, Homo sapiens; identical to SEQ ID NO: 802162

SEQ ID NO: 802164 - protein, 425 aa, Homo sapiens; identical to SEQ ID NO: 802162

SEQ ID NO: 802165 - protein, 388 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLAENIYNDEESDVTTSELEGQGS

SEQ ID NO: 802166 - protein, 175 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPEVTRRKAMVSPGIQI

SEQ ID NO: 802167 - protein, 520 aa, Homo sapiens
YRRPTALGNRPPRVIGLGAGAVGSQTRLSASSHFSQGGCACAQLPGRAGRRGLKSLVPSLERERRAPQTSVPASGEEAGKKDAASGEHPGSKTGPGLSTVVFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 802168 - protein, 391 aa, Homo sapiens
MTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 802169 - protein, 395 aa, Homo sapiens
RSSRENYPRRNYYRTESQTDGFRRPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 802170 - protein, 416 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 802171 - protein, 404 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEKHHQKCPWASELLVIYGDTLLRFFSWTPRAWVFARAGEQHQYGEGGISCGGRV

SEQ ID NO: 802172 - protein, 325 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVVMGSGTLNYMHTSIYKMNLVTGFNMNIW

SEQ ID NO: 802173 - protein, 253 aa, Homo sapiens [sequence omitted]

SEQ ID NO: 802174 - protein, 204 aa, Homo sapiens; identical to SEQ ID NO: 802161

SEQ ID NO: 802175 - protein, 172 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPARSKVWLFRNHN

SEQ ID NO: 802176 - protein, 425 aa, Homo sapiens; identical to SEQ ID NO: 802162

SEQ ID NO: 802177 - protein, 444 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKVCDSFLVSVCQEMKSRDSSVKLYQTRGSTIEKNVLYVVLHGDAHRVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 802178 - protein, 228 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGCGLAPAARVIVWICC

SEQ ID NO: 802179 - protein, 155 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPTQVENVILISD

SEQ ID NO: 802180 - protein, 583 aa, Homo sapiens
MSTHGARKPPAARHWSRRRSRWLPDPPLRLLSLFPGRMRLRSAAWAGWEARVEKSRSKFGEREKSASDLGTRERGGGRKEGRGVWGAPRQQDGARAFDSGGQCVPLLWCRYGQAVRPMRVWSVHHCAYNDVSDVPHALRRLDGGLQNLNPGRRKGLGRSYTMEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 802181 - protein, 425 aa, Homo sapiens; identical to SEQ ID NO: 802162

SEQ ID NO: 802182 - protein, 294 aa, Homo sapiens
MPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 802183 - protein, 146 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGGKIECEIKINHEGEVNRARYMPQNPHIIATKTPTQVENVILISD

SEQ ID NO: 802184 - protein, 159 aa, Homo sapiens
EEPCELQEFVTTFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPEVTRRKAMVSPGIQI

SEQ ID NO: 802185 - protein, 175 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPARPKWRMDPGLRLSH

SEQ ID NO: 802186 - protein, 129 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGGRYIIYSNIGVKGKMSLSKHMLLKLYY

SEQ ID NO: 802187 - protein, 131 aa, Homo sapiens
GEPIVAISKCLPTQFQTLILHPSCCRPGFLYKPRCSAAPTLPAGTATPDGHVGWAVPFPPTVAPQGGPQDLHPSHADGAFSTSSVLGRWRKAQPHGLALPGASHIVPPTLCAPGGVKGPGAFDPQLRLAMP

SEQ ID NO: 802188 - protein, 566 aa, Homo sapiens
MVLEGNPEVGSPRTSDLQHRGNKGSCVLSSPGEDAQPGEEPIKYGELIVLGYNGCLASGDKGRRRSRLALSRRSHANGVKPDVMHHISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRCGHVHGYHGWGCRRERGPQERECPLCRLVGPYVPLWLGQEAGLCLDPGPPSHAFAPCGHVCSEKTARYWAQTPLPHGTHAFHAACPFCGAWLTGEHGLRPPHFPGPAGLGSLGPPAAVPTCPPRSPPPAAQRELCMWDTPCWHSTPDGHVGWAVPFPPTVAPQGGPQDLHPSHADGAFSTSSVLGRWRKAQPHGLALPGASHIVPPTLCAPGGVKGPGAFDPQLRLAMP

SEQ ID NO: 802189 - protein, 590 aa, Homo sapiens
MVLEGNPEVGSPRTSDLQHRGNKGSCVLSSPGEDAQPGEEPIKYGELIVLGCCEEGGEETEAQRGEVTGPRAHSCYNGCLASGDKGRRRSRLALSRRSHANGVKPDVMHHISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRCGHVHGYHGWGCRRERGPQERECPLCRLVGPYVPLWLGQEAGLCLDPGPPSHAFAPCGHVCSEKTARYWAQTPLPHGTHAFHAACPFCGAWLTGEHGLRPPHFPGPAGLGSLGPPAAVPTCPPRSPPPAAQRELCMWDTPCWHSTPDGHVGWAVPFPPTVAPQGGPQDLHPSHADGAFSTSSVLGRWRKAQPHGLALPGASHIVPPTLCAPGGVKGPGAFDPQLRLAMP

SEQ ID NO: 802190 - protein, 185 aa, Homo sapiens
QAGTGLEYIGSHPPPPALGVPVTRQRGAAAGRAHPAAAARGRAGARRGGSGAQRGPERGQPVAAQRPTNSSPGSTSAAGTSMATTAGAAGGSGAPRSANVLSAALWGLMCLYGLARRPASAWTLGRLAMPLHLAATSALRRLPATGPRHHCPTAPMLSMPPAPFAGPGLPASMGCVRLIFQGPLD

SEQ ID NO: 802191 - protein, 149 aa, Homo sapiens
MGRSLVLWGQQRRRSCSRPRLLGLGDPTWEPRGPMELVLPLLQGLAASFFGDLAYRAAAGTLGGKAHESPLCTYSPCLLSLSSQIGRSTENMIDFVVTDTSPGGGAAEGPSAQSTISRYACRILCDRRPPYTARIYAAGFDASSNIFLG

SEQ ID NO: 802192 - protein, 202 aa, Homo sapiens
RFTRMGSKSTGWEACSIQKGVACAQAQVSVSQKSSDRVSDGWSMDCGGNREGGGAKGWDHVTREDAGWRILNLICGLGRSLPTQFQTLILHPSCCRPGFLYKPRCSAAPTSPTCPACVQCLQPPSEWWVGGRLGLALADSHYGLDSVLSGIWGHRGNQTWFPPWWSSQSSGGQTVNKWQHGFMRARIRVQIRLWQASLVMEK

SEQ ID NO: 802193 - protein, 590 aa, Homo sapiens; identical to SEQ ID NO: 802189

SEQ ID NO: 802194 - protein, 566 aa, Homo sapiens; identical to SEQ ID NO: 802188

SEQ ID NO: 802195 - protein, 131 aa, Homo sapiens; identical to SEQ ID NO: 802187

SEQ ID NO: 802196 - protein, 87 aa, Homo sapiens
GGFSEDSAPGVWREISVCGNVYTLRDSRSAQQRGKLVGGPLHSPPLSLPGPHKLPIPLPKPGDDLQSFCPREPQQAPYQGIPGPGGS

SEQ ID NO: 802197 - protein, 137 aa, Homo sapiens
KTKITIVKTFNASGVKPQRNICNLSSICNDSAFFRGEIMFQYDKESTVPQNQHITNGTLTGVPSLSELKRSELNKTLQTLSETYFIMCATAEAQSTLNCTFTTKLNNTMNACAVIAALERVKIRPMEHCCCSVRKQH

SEQ ID NO: 802198 - protein, 401 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802199 - protein, 401 aa, Homo sapiens; identical to SEQ ID NO: 802198

SEQ ID NO: 802200 - protein, 401 aa, Homo sapiens; identical to SEQ ID NO: 802198

SEQ ID NO: 802201 - protein, 401 aa, Homo sapiens; identical to SEQ ID NO: 802198

SEQ ID NO: 802202 - protein, 401 aa, Homo sapiens; identical to SEQ ID NO: 802198

SEQ ID NO: 802203 - protein, 401 aa, Homo sapiens; identical to SEQ ID NO: 802198

SEQ ID NO: 802204 - protein, 452 aa, Homo sapiens
RGCCIGRAWVLFRCRRQAVLPDTGPNPASPLPEHRPRLHRGPGPPARLAAAMADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802205 - protein, 314 aa, Homo sapiens
MLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802206 - protein, 378 aa, Homo sapiens
MADPKYADLPGIEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802207 - protein, 495 aa, Homo sapiens
DAWVADAWPSAVLLLSRDFLLICRSLCRRLSPGPGDRTQPLPYPNTGPGSTEARVPQPVSPPPWRTLNTPTFPALPGMSQMFMKLATYLRMIKRSSMRSSRHCWSRCYWRTRVCSRATALERLQRMQRQEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802208 - protein, 384 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802209 - protein, 401 aa, Homo sapiens; identical to SEQ ID NO: 802198

SEQ ID NO: 802210 - protein, 401 aa, Homo sapiens; identical to SEQ ID NO: 802198

SEQ ID NO: 802211 - protein, 379 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802212 - protein, 115 aa, Homo sapiens
MADPKYADLPGIARNEPDVYETSDLPEDDQAEFDAEELTSTSVEHIIVTIKQLHEQAMQFGQLLTHLDTTQQMIANSLKDNTTLLTQVQTTMRENLATVEGNFASIDERMKKLGK

SEQ ID NO: 802213 - protein, 290 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQAWGIRTWAQPHANSCPILLCLVWGRIGSCPPTQLLWLTVILYNCF

SEQ ID NO: 802214 - protein, 265 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGSTGTFSENVKLQQG

SEQ ID NO: 802215 - protein, 139 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELMPTHVQYCFAWCGEGLGLVPQHSFCG

SEQ ID NO: 802216 - protein, 139 aa, Homo sapiens; identical to SEQ ID NO: 802215

SEQ ID NO: 802217 - protein, 39 aa, Homo sapiens
MCGLAYSLISYLTPPCGSGSYIVGNTFSVPSPSGVFLVA

SEQ ID NO: 802218 - protein, 401 aa, Homo sapiens; identical to SEQ ID NO: 802198

SEQ ID NO: 802219 - protein, 401 aa, Homo sapiens; identical to SEQ ID NO: 802198

SEQ ID NO: 802220 - protein, 401 aa, Homo sapiens; identical to SEQ ID NO: 802198

SEQ ID NO: 802221 - protein, 401 aa, Homo sapiens; identical to SEQ ID NO: 802198

SEQ ID NO: 802222 - protein, 314 aa, Homo sapiens; identical to SEQ ID NO: 802205

SEQ ID NO: 802223 - protein, 415 aa, Homo sapiens
MADPKYADLPGIARNEPDVYETSDLPEDDQAEFDAELVRSLTFHLLFNGEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802224 - protein, 401 aa, Homo sapiens; identical to SEQ ID NO: 802198

SEQ ID NO: 802225 - protein, 401 aa, Homo sapiens; identical to SEQ ID NO: 802198

SEQ ID NO: 802226 - protein, 252 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQGQVFSCT

SEQ ID NO: 802227 - protein, 167 aa, Homo sapiens
METAVRCDQDANPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 802228 - protein, 252 aa, Homo sapiens; identical to SEQ ID NO: 802226

SEQ ID NO: 802229 - protein, 252 aa, Homo sapiens; identical to SEQ ID NO: 802226

SEQ ID NO: 802230 - protein, 107 aa, Homo sapiens
AVGFGGWVALVVVVPPRCVSCVPLALWLRRSVRLVVGLLLRTPRWSLYVSLRVAAFFGWLCLCHVVLCLFFFFFFFLFCFFFVLLVFLFFFFFFFFARVSKYSHLLN

SEQ ID NO: 802231 - protein, 122 aa, Homo sapiens
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELLTVILYNCF

SEQ ID NO: 802232 - protein, 609 aa, Homo sapiens
MPHLLVTFRDVAIDFSQEEWECLDPAQRDLYRDVMLENYSNLISLDLESSCVTKKLSPEKEIYEMESLQWENMGKRINHHLQYNGLGDNMECKGNLEGQEASQEGLYMCVKITCEEKATESHSTSSTFHRIIPTKEKLYKCKECRQGFSYLSCLIQHEENHNIEKCSEVKKHRNTFSKKPSYIQHQRIQTGEKPYECMECGKAFGRTSDLIQHQKIHTNEKPYQCNACGKAFIRGSQLTEHQRVHTGEKPYDCKKCGKAFSYCSQYTLHQRIHSGEKPYECKDCGKAFILGSQLTYHQRIHSGEKPYECKECGKAFILGSHLTYHQRVHTGEKPYICKECGKAFLCASQLNEHQRIHTGEKPYECKECGKTFFRGSQLTYHLRVHSGERPYKCKECGKAFISNSNLIQHQRIHTGEKPYKCKECGKAFICGKQLSEHQRIHTGEKPFECKECGKAFIRVAYLTQHEKIHGEKHYECKECGKTFVRATQLTYHQRIHTGEKPYKCKECDKAFIYGSQLSEHQRIHRGEKPYECKQCGKAFIRGSHLTEHLRTHTGEKPYECKECGRAFSRGSEHTLHQRIHTGEKPYTCVQCGKDFRCPSQLTQHTRLHN

SEQ ID NO: 802233 - protein, 612 aa, Homo sapiens
MDLLFQLLVTFRDVAIDFSQEEWECLDPAQRDLYRDVMLENYSNLISLDLESSCVTKKLSPEKEIYEMESLQWENMGKRINHHLQYNGLGDNMECKGNLEGQEASQEGLYMCVKITCEEKATESHSTSSTFHRIIPTKEKLYKCKECRQGFSYLSCLIQHEENHNIEKCSEVKKHRNTFSKKPSYIQHQRIQTGEKPYECMECGKAFGRTSDLIQHQKIHTNEKPYQCNACGKAFIRGSQLTEHQRVHTGEKPYDCKKCGKAFSYCSQYTLHQRIHSGEKPYECKDCGKAFILGSQLTYHQRIHSGEKPYECKECGKAFILGSHLTYHQRVHTGEKPYICKECGKAFLCASQLNEHQRIHTGEKPYECKECGKTFFRGSQLTYHLRVHSGERPYKCKECGKAFISNSNLIQHQRIHTGEKPYKCKECGKAFICGKQLSEHQRIHTGEKPFECKECGKAFIRVAYLTQHEKIHGEKHYECKECGKTFVRATQLTYHQRIHTGEKPYKCKECDKAFIYGSQLSEHQRIHRGEKPYECKQCGKAFIRGSHLTEHLRTHTGEKPYECKECGRAFSRGSEHTLHQRIHTGEKPYTCVQCGKDFRCPSQLTQHTRLHN

SEQ ID NO: 802234 - protein, 424 aa, Homo sapiens
GAGPAGAVRGKGPRTRRSRRAGQCWPLAERWGSMKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 802235 - protein, 195 aa, Homo sapiens
HRLIIRGWLPSAASPWRRQHFLPQGIRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 802236 - protein, 315 aa, Homo sapiens
MQSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 802237 - protein, 453 aa, Homo sapiens
GAGPAGAVRGKGPRTRRSRRAGQCWPLAERWGSMKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRYVPSLGTGKGSGMAGAEWDDQLGPPPLPRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 802238 - protein, 442 aa, Homo sapiens
PTAASSLTFAIRCAARGTPRSPGARKAEACRGSQEQLAGGRRGPPRSRDTPDNVRRHVTAEALLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 802239 - protein, 342 aa, Homo sapiens
MQSFLSVFRSLAMLEKTVEKCCISLNGRSSRLVVQLHCKFGEWAAGQPRGASAGRSARPTETLIAHPGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 802240 - protein, 245 aa, Homo sapiens
MKSFLSVFRSLAMLEKTVEKCCISLNGRSSRLVVQLHCKFDSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 802241 - protein, 344 aa, Homo sapiens
MQSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRYVPSLGTGKGSGMAGAEWDDQLGPPPLPRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 802242 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 802243 - protein, 638 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKL

SEQ ID NO: 802244 - protein, 1073 aa, Homo sapiens; identical to SEQ ID NO: 802242

SEQ ID NO: 802245 - protein, 1073 aa, Homo sapiens; identical to SEQ ID NO: 802242

SEQ ID NO: 802246 - protein, 1073 aa, Homo sapiens; identical to SEQ ID NO: 802242

SEQ ID NO: 802247 - protein, 511 aa, Homo sapiens
MEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 802248 - protein, 197 aa, Homo sapiens
MTKNYINWNYFGYNFFQESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 802249 - protein, 1073 aa, Homo sapiens; identical to SEQ ID NO: 802242

SEQ ID NO: 802250 - protein, 860 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRLINLGKPLTNLGSTLSNSLGKHVRE

SEQ ID NO: 802251 - protein, 288 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGRSRHRWLPLPTFSDTLCETPSQGLWPLDF

SEQ ID NO: 802252 - protein, 1073 aa, Homo sapiens; identical to SEQ ID NO: 802242

SEQ ID NO: 802253 - protein, 1091 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 802254 - protein, 1073 aa, Homo sapiens; identical to SEQ ID NO: 802242

SEQ ID NO: 802255 - protein, 478 aa, Homo sapiens
IGSGVVLVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 802256 - protein, 117 aa, Homo sapiens
MDSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 802257 - protein, 1019 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRGSPASFRFRTCLFSLYPTLMS

SEQ ID NO: 802258 - protein, 112 aa, Homo sapiens
STPGDHLVSILFPRKLPGRRGTGRRAGFLLANCFLPAAAELRSRADRRMSDSPSLSTLATRRSLRWPGETYNTLQQIPWEGGGKRLKLEENSDVWKRFPEITRRKCFPVYKF

SEQ ID NO: 802259 - protein, 261 aa, Homo sapiens
DAVVAAERLEGAAGQAEGASARDRAAAAAMATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERYDFHKLFHILGFLYSSLQIIIRSIYLQCGFILLFSPL

SEQ ID NO: 802260 - protein, 633 aa, Homo sapiens
GLEVPRRPGARTGPATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQSSSLSFTQSCLNYTRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 802261 - protein, 196 aa, Homo sapiens
MEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 802262 - protein, 639 aa, Homo sapiens
GLEVPRRPGARTGPATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPTWQLLHLHVSQTLHLLLLWLCHQLQYQYELVLDLVVRRTK

SEQ ID NO: 802263 - protein, 612 aa, Homo sapiens
GLEVPRRPGARTGPATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKTWQLLHLHVSQTLHLLLLWLCHQLQYQYELVLDLVVRRTK

SEQ ID NO: 802264 - protein, 619 aa, Homo sapiens
GLEVPRRPGARTGPATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 802265 - protein, 619 aa, Homo sapiens; identical to SEQ ID NO: 802264

SEQ ID NO: 802266 - protein, 619 aa, Homo sapiens; identical to SEQ ID NO: 802264

SEQ ID NO: 802267 - protein, 552 aa, Homo sapiens
GLEVPRRPGARTGPATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQVSRTFS

SEQ ID NO: 802268 - protein, 530 aa, Homo sapiens
GLEVPRRPGARTGPATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSE

SEQ ID NO: 802269 - protein, 485 aa, Homo sapiens
GLEVPRRPGARTGPATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRYSISSLSFFFSFLLPFFFIQFLHLPQKPLGRHRLGHVFCLSPAGFCVFALVVAWNQVALYYADSFEVVIL

SEQ ID NO: 802270 - protein, 109 aa, Homo sapiens
DPAVRAGLGAGRGGGRAGQGGGRGPPGAPALADGHPRGLPRALLAPGLCRGHRVDSQRPERSRGGVGAKAQLGAEAARAFPWASVRRGAFTRAGTAASSRAARAATRAH

SEQ ID NO: 802271 - protein, 963 aa, Homo sapiens
MGLPEPGPLRLLALLLLLLLLLLLRLQHLAAAAADPLLGGQGPAKECEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATVSQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 802272 - protein, 793 aa, Homo sapiens [sequence omitted]

SEQ ID NO: 802273 - protein, 700 aa, Homo sapiens [sequence omitted]

SEQ ID NO: 802274 - protein, 571 aa, Homo sapiens
MGLPEPGPLRLLALLLLLLLLLLLRLQHLAAAAADPLLGGQGPAKECEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATVSQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGSAEPALVLGRLQATPTVQH

SEQ ID NO: 802275 - protein, 998 aa, Homo sapiens
MGLPEPGPLRLLALLLLLLLLLLLRLQHLAAAAADPLLGGQGPAKECEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATVSQFACRSGECVHLGWRCDGDRDCKDKSDEADCPLGTCRGDEFQCGDGTCVLAIKHCNQEQDCPDGSDEAGCLQVPPTFLGNRRRPRGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRVSGSFWNALKTSSEEPLIAVASAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 802276 - protein, 122 aa, Homo sapiens
MSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 802277 - protein, 762 aa, Homo sapiens
MGLPEPGPLRLLALLLLLLLLLLLRLQHLAAAAADPLLGGQGPAKECEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATVSQFACRSGECVHLGWRCDGDRDCKDKSDEADCPLGTCRGDEFQCGDGTCVLAIKHCNQEQDCPDGSDEAGCLQVPPTFLGNRRRPRGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRVSGSFWNALKTSS

SEQ ID NO: 802278 - protein, 415 aa, Homo sapiens
MGLPEPGPLRLLALLLLLLLLLLLRLQHLAAAAADPLLGGQGPAKECEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATVSQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGGETFSHTPKQKQILLLVLTPAPPHSLRRDGEGLWHRDLRC

SEQ ID NO: 802279 - protein, 700 aa, Homo sapiens [sequence omitted]

SEQ ID NO: 802280 - protein, 976 aa, Homo sapiens
MGLPEPGPLRLLALLLLLLLLLLLRLQHLAAAAADPLLGGQGPAKECEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATVSQFACRSGECVHLGWRCDGDRDCKDKSDEADCPLGTCRGDEFQCGDGTCVLAIKHCNQEQDCPDGSDEAGCLQVPPTFLGNRRRPRGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 802281 - protein, 762 aa, Homo sapiens; identical to SEQ ID NO: 802277

SEQ ID NO: 802282 - protein, 762 aa, Homo sapiens; identical to SEQ ID NO: 802277

SEQ ID NO: 802283 - protein, 682 aa, Homo sapiens
MGLPEPGPLRLLALLLLLLLLLLLRLQHLAAAAADPLLGGQGPAKECEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATVSQFACRSGECVHLGWRCDGDRDCKDKSDEADCPLGTCRGDEFQCGDGTCVLAIKHCNQEQDCPDGSDEAGCLQVPPTFLGNRRRPRGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFADNGLTDTPYYTPHYTP

SEQ ID NO: 802284 - protein, 160 aa, Homo sapiens
VVIALLCMSGYLIWRNWKRKNTKSMNFDNPVYRKTTEEEDEDELHIGRTAQIGHVYPAVSISHWENSYLPTIFPSILSSPPILSSFPSFLPSLPSFRPSLPPFLPSFPPSLSFFFPSFLPFLPPSLPPSFLPQTFIKNAPCIRHCSRPWGTQKCWGRWLR

SEQ ID NO: 802285 - protein, 67 aa, Homo sapiens
MIICTAVQKYSFLLDSENPRTSTQRACSKEGMRFCRAVVRAVIRKDASGSIVFPSKLPSSASAGCGW

SEQ ID NO: 802286 - protein, 324 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802287 - protein, 338 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPKRRGWCPRSWPKSSLNLAPKVPGLSPVTRGVTSSRASCRCCMAGGTGASRGGPQPRWRRSSHGGEGGGWSPVAGGTRLRGGSPTKPPVGVSGALRVFCAQIRRLL

SEQ ID NO: 802288 - protein, 255 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQVRPGLPGSPRPQHWGVFISSITPLTHGVWIFLLP

SEQ ID NO: 802289 - protein, 266 aa, Homo sapiens
HIFERHNTVQNTNEQIRKSNHCEQTQLTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDTRPTRGQDLPKAEGPLPFNNGRPGESQPNGLIGGSTRTKGFLLDKVA

SEQ ID NO: 802290 - protein, 324 aa, Homo sapiens; identical to SEQ ID NO: 802286

SEQ ID NO: 802291 - protein, 340 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTHGEISRSREPIHAGGDARGQGDLLGVSRSPGGGVSSHGGEMGAVGPGPWAHPASGGFPRKTAGDRRGLWCVLPPP

SEQ ID NO: 802292 - protein, 340 aa, Homo sapiens
NPQTTPPFMMSRGLLAEGQRTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802293 - protein, 279 aa, Homo sapiens
MVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802294 - protein, 279 aa, Homo sapiens; identical to SEQ ID NO: 802293

SEQ ID NO: 802295 - protein, 439 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 802296 - protein, 327 aa, Homo sapiens
FIWQTCFTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802297 - protein, 341 aa, Homo sapiens
PVRPRFIRPRTLAVGEHHGNVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802298 - protein, 279 aa, Homo sapiens; identical to SEQ ID NO: 802293

SEQ ID NO: 802299 - protein, 313 aa, Homo sapiens
MATVTATTKVPEIRDVTRIERIGAHSHIRGLGLDDALEPRQASQGMVGQLAARRAAGVVLEMIREGKIAGRAVLIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802300 - protein, 161 aa, Homo sapiens [sequence omitted]

SEQ ID NO: 802301 - protein, 490 aa, Homo sapiens
KPRARYEAWVVRLVSIMATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITGGNSNPQNSGNRQGDGQDLQAGPLLHTRPRLRRYGLPDQVRAVPRWGSSRNARRWCTPCPCTRSNVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 802302 - protein, 161 aa, Homo sapiens [sequence omitted]

SEQ ID NO: 802303 - protein, 152 aa, Homo sapiens
RYSFGTRYSSAPQYEYRPGKRGLTILRYSSAPRYSSAPLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 802304 - protein, 81 aa, Homo sapiens
PTFKIILAQRPVPQSLAPVCDEEGCRTLRFEPFGSLGLLVVPMALEFQAGSTGRYLFSVSESARAPSEPLVGRNCRGTRES

SEQ ID NO: 802305 - protein, 279 aa, Homo sapiens; identical to SEQ ID NO: 802293

SEQ ID NO: 802306 - protein, 357 aa, Homo sapiens
PVRPRFIRPRTLAVGEHHGNVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTHGEISRSREPIHAGGDARGQGDLLGVSRSPGGGVSSHGGEMGAVGPGPWAHPASGGFPRKTAGDRRGLWCVLPPP

SEQ ID NO: 802307 - protein, 324 aa, Homo sapiens; identical to SEQ ID NO: 802286

SEQ ID NO: 802308 - protein, 324 aa, Homo sapiens; identical to SEQ ID NO: 802286

SEQ ID NO: 802309 - protein, 279 aa, Homo sapiens; identical to SEQ ID NO: 802293

SEQ ID NO: 802310 - protein, 330 aa, Homo sapiens
LVANSARGSCTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802311 - protein, 324 aa, Homo sapiens; identical to SEQ ID NO: 802286

SEQ ID NO: 802312 - protein, 340 aa, Homo sapiens
KPRARYEAWVVRLVSIMATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802313 - protein, 324 aa, Homo sapiens; identical to SEQ ID NO: 802286

SEQ ID NO: 802314 - protein, 339 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPKRRGWCPRSWPKSSLNLAPKVPGLSPVTRGVTSSRASCRCCMAGGTGASRGGPQPRWRRSSHGGEGGGWSPVAGGTRLRGGSPTKPPGGSDAAPFVSFVLRFVVCC

SEQ ID NO: 802315 - protein, 312 aa, Homo sapiens
SGSGEHHGNRCAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGGAPETQGGGAHRVPARDRTSSTLAPRASWRSSQVTQGRSSQKSVSRSMPRWLSGARRARRRSSLECCSSTRSTCWTSRASPSSTGPWRVTWRLS

SEQ ID NO: 802316 - protein, 161 aa, Homo sapiens [sequence omitted]

SEQ ID NO: 802317 - protein, 260 aa, Homo sapiens
MPFPALSPPFFPHPRPIDQVRAVPRWGSSRNARRWCTPCPCTRSNVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 802318 - protein, 177 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKRERHEADPPHPVRGRRCGDE

SEQ ID NO: 802319 - protein, 85 aa, Homo sapiens
GGWASLGPFLSLPYPPSPCRDVITIDKATGKISKLGRSFTRARDYDAMGSQVRPGLPGSPRPQHWGVFISSITPLTHGVWIFLLP

SEQ ID NO: 802320 - protein, 180 aa, Homo sapiens
GRPVRRRPAARVLRLRCRGSRARSLQQARGQQRVAQGSGPVQRREARPGASRRRGPALQQQLGHPRVSVPGGLVQRGAPRPVHRAHRGPSLQQETHQGRVAPQHGQKESSVRLTGKEARSSGGWVESPVLIRAREATETTSRQLPRGTAARMDLEEAPPKTPVSRVPPQWGQPQLPLQCL

SEQ ID NO: 802321 - protein, 183 aa, Homo sapiens
AALRFLLARGARVDARDGAGATALGLAAALGRSQDIEVLLGHGADPGIRDRHGRSALHRAAARGHLLAVQLLVTQGAEVDARDTLGLTPLHHASREGHVEVAGCLLDRGAQVDATGWLRKTPLHLAAERGHGPTVGLLLSRGASPTLRTQWAEVAQMPEGDLPQALPELGGGEKECEGIESTG

SEQ ID NO: 802322 - protein, 174 aa, Homo sapiens
MDSQRPEPREEEEEEQELRWMELDSEEALGTRTEGPSVVQGWGHLLQAVWRGPAGLVTQLLRQGASVEERTLRCCWATGQTQASGTGMAALRCTGLPPEDTCLPSSCWSPRGPRWMRGTPWASHPCITPLGKATWRLPAACWTGVPRWMLPAGSERPPYTWLQSEGMGLPWGFC

SEQ ID NO: 802323 - protein, 157 aa, Homo sapiens
ATRPMPHKDIEVLLGHGADPGIRDRHGRSALHRAAARGHLLAVQLLVTQGAEVDARDTLGLTPLHHASREGHVEVAGCLLDRGAQVDATGWLRKTPLHLAAERGHGPTVGLLLSRGASPTLRTQWAEVAQMPEGDLPQALPELGGGEKECEGIESTG

SEQ ID NO: 802324 - protein, 185 aa, Homo sapiens
MDSQRPEPREEEEEEQELRWMELDSEEALGTRTEGPSVVQGWGHLLQAVWRGPAGLVTQLLRQGASVEERDHAGRTPLHLAVLRGHAPLVRLLLQRGAPVGAVDRAGRTALHEAAWHGHSRVAELLLQRGASAAARSGTGLTPLHWAAALGHTLLAARLLEAPGPGPAAAEAEDARGWTAAHWAA

SEQ ID NO: 802325 - protein, 164 aa, Homo sapiens
AAALGRSQVRPALRPAVMGGGAGPGSPETCHRGSWSQAGGRCPGTKALSAPPAVPLRCSPVPWRPGRDPRPGARLHAGGSNRLSASAGPVPETPVPGQRAGCWLQILGFALRTLRGKSGRFQAGQPWVRPHNMRKWCQERQAAAGTEEAWAGQTPGGSAPRLPG

SEQ ID NO: 802326 - protein, 174 aa, Homo sapiens; identical to SEQ ID NO: 802322

SEQ ID NO: 802327 - protein, 174 aa, Homo sapiens; identical to SEQ ID NO: 802322

SEQ ID NO: 802328 - protein, 116 aa, Homo sapiens
RTSPCPPPQPGIGRRGRHPPLGGLSQLGQEWVRGLPEGGPHGEPCEAFQGHIGVHPRLRFLGEVASEQLSSTSMFLLVLPNRLAFVPQEGSRTGALAASRGGSMLDRGLCPKAGPS

SEQ ID NO: 802329 - protein, 61 aa, Homo sapiens
MCGVCHSSQQPPEPLTEMWRTSAIKALNATGQANLSLEALFQILSVVPVYNNLTIYTTVMS

SEQ ID NO: 802330 - protein, 199 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDPE

SEQ ID NO: 802331 - protein, 323 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQ

SEQ ID NO: 802332 - protein, 222 aa, Homo sapiens
MCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQ

SEQ ID NO: 802333 - protein, 237 aa, Homo sapiens
STHASARNRDGPADIWPLDPLNGAWFRVETNYDHWKPAPKEDDRRTSAIKALNATGQANLSLEALFQILRWFQFITMKAGQVRWLTPVIPALWECLTQADSGCAILKEWADKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQ

SEQ ID NO: 802334 - protein, 334 aa, Homo sapiens [sequence omitted]

SEQ ID NO: 802335 - protein, 323 aa, Homo sapiens; identical to SEQ ID NO: 802331

SEQ ID NO: 802336 - protein, 326 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQMIF

SEQ ID NO: 802337 - protein, 323 aa, Homo sapiens; identical to SEQ ID NO: 802331

SEQ ID NO: 802338 - protein, 156 aa, Homo sapiens
IPWLVNDDDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQILSVVPVYNKPHNLYYGNERR

SEQ ID NO: 802339 - protein, 344 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQILSVVPVYNKPHNLYYGNERR

SEQ ID NO: 802340 - protein, 327 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWSRVKSDYDHGVGGRSTNRIGQYRPSRAPEATWTQRSACRDDHFSRC

SEQ ID NO: 802341 - protein, 323 aa, Homo sapiens; identical to SEQ ID NO: 802331

SEQ ID NO: 802342 - protein, 323 aa, Homo sapiens; identical to SEQ ID NO: 802331

SEQ ID NO: 802343 - protein, 323 aa, Homo sapiens; identical to SEQ ID NO: 802331

SEQ ID NO: 802344 - protein, 373 aa, Homo sapiens
SRPKDVAPLAVHTQSQRRRPLSGSDALVLFVSRDRVPKWVHVLIGKVVLELERFLPQPFTGEIRGMCDFMNLSLADCLLVNLAYESSVLSAPSPRGVTRGLRGPPTQTSGRRHIFRVIKTGRCLLPRNLQRFLFASLGKSELHIVGFERESRFSDSTLNFPSTCSPGFSLPQSRFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQ

SEQ ID NO: 802345 - protein, 344 aa, Homo sapiens; identical to SEQ ID NO: 802339

SEQ ID NO: 802346 - protein, 323 aa, Homo sapiens; identical to SEQ ID NO: 802331

SEQ ID NO: 802347 - protein, 323 aa, Homo sapiens; identical to SEQ ID NO: 802331

SEQ ID NO: 802348 - protein, 323 aa, Homo sapiens; identical to SEQ ID NO: 802331

SEQ ID NO: 802349 - protein, 69 aa, Homo sapiens
LIPRVSHGPSSLNGAWFRVETNYDHWKPAPKEDDRRTSAIKALNATGQANLSLEALFQPHNLYYGNERR

SEQ ID NO: 802350 - protein, 308 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAPLVLQGCSWKRFLTNVKRETGGSQWFQT

SEQ ID NO: 802351 - protein, 128 aa, Homo sapiens [sequence omitted]

SEQ ID NO: 802352 - protein, 132 aa, Homo sapiens
QEPEIEGRRPRLGVVHEEREEGNKARLKRKRENRKRPFPETDRQTNPRRVKSTVFPACWEPSPHFELGQRSPAHKASEEGMSLPNWRISSRAQLRNTCHSTRRFTPNFKSSFLESRRLSTPQVWSPGPEAGR

SEQ ID NO: 802353 - protein, 128 aa, Homo sapiens
QEPEIEGRRPRLGVVHEEREEGNKARLKRKRENRKRPFPETDRQTNPRRVKSTVFPACWEPSPHFELGQRSPAHKASEEGMSLPNWRISSRAQLRNTCHSTRRFTPNFKSSFLESRRLSTPQMRKPRH

SEQ ID NO: 802354 - protein, 318 aa, Homo sapiens
MSSFLINSNYIEPKFPPFEEYAQHSGSGGADGGPGGGPGYQQPPAPPTQHLPLQQPQLPHAGGGREPPASYYAPRTAREPAYPAAALYPAHGAADTAYPYGYRGGASPGRPPQPEQPPAQAKGPAHGLHASHVLQPQPPPPLQPRAVPPAAPRRCEAAPATPGVPAGGSAPACPLLLADKSPLGLKGKEPVVYPWMKKIHVSAVNPSYNGGEPKRSRTAYTRQQVLELEKEFHFNRYLTRRRRIEIAHTLCLSERQVKIWFQNRRMKWKKDHKLPNTKMRSSNSASASAGPPGKAQTQSPHLHPHPHPSTSTPVPSSI

SEQ ID NO: 802355 - protein, 300 aa, Homo sapiens
RRSGGARWFREHSGFGILQSERLPVVLRPVGLAALRRIGYGKEGRLWLQERAVKGRGRTCVLWALVWASELAGPRWPSRSHTYILPDHPPGWQRWSCSMGSPGQGQTVGPSSPSCPPWRETEEFYQQSNSVLACNRASYEYGASCFYSDKDLSGASPSGSGKQRGPGDYLHFSPEQQYKPDSSSGQGKALHDEGADRKYTSPVYPWMQRMNSCAGAVYGSHGRRGRQTYTRYQTLELEKEFHFNRYLTRRRRIEIANALCLTERQIKIWFQNRRMKWKKENKLINSTQPSGEDSEAKAGE

SEQ ID NO: 802356 - protein, 245 aa, Homo sapiens
MWMRTVNMNFFIISLARIEPHSFAPLRPACFGALPSSRARLCFVRRWRAKGSPGQARPGGSRWRLGALRSRRRGSSFATRNLANFLRPLAPGKRTILLSGCPSDSCQRGRSFWEPPCYVCRLAIQTVNFRSRSVQTTSSQNSLKNGSLRVKVLELEKEFHFNRYLTRRRRIEIAHTLCLSERQVKIWFQNRRMKWKKDHKLPNTKMRSSNSASASAGPPGKAQTQSPHLHPHPHPSTSTPVPSSI

SEQ ID NO: 802357 - protein, 328 aa, Homo sapiens
MWMRTVNMNFFIISLARIEPHSFAPLRPACFGALPSSRARLCFVRRWRAKGSPGQARPGGSRWRLGALRSRRRGSSFATRNLANFLRPLAPGKRTILLSGCPSDSCQRGRSFWEPPLIQPEFSARCRLPFARFFDEEVSEALGGGIGAWVEFYQQSNSVLACNRASYEYGASCFYSDKDLSGASPSGSGKQRGPGDYLHFSPEQQYKPDSSSGQGKALHDEGADRKYTSPVYPWMQRMNSCAGAVYGSHGRRGRQTYTRYQTLELEKEFHFNRYLTRRRRIEIANALCLTERQIKIWFQNRRMKWKKENKLINSTQPSGEDSEAKAGE

SEQ ID NO: 802358 - protein, 318 aa, Homo sapiens; identical to SEQ ID NO: 802354

SEQ ID NO: 802359 - protein, 234 aa, Homo sapiens
MSSYFVNPTFPGSLPSGQDSFLGQLPLYQAGYDALRPFPASYGASSLPDKTYTSPCFFYQQSNSVLACNRASYEYGASCFYSDKDLSGASPSGSGKQRGPGDYLHFSPEQQYKPDSSSGQGKALHDEGADRKYTSPVYPWMQRMNSCAGAVYGSHGRRGRQTYTRYQTLELEKEFHFNRYLTRRRRIEIANALCLTERQIKIWFQNRRMKWKKENKLINSTQPSGEDSEAKAGE

SEQ ID NO: 802360 - protein, 500 aa, Homo sapiens
MSSFLINSNYIEPKFPPFEEYAQHSGSGGADGGPGGGPGYQQPPAPPTQHLPLQQPQLPHAGGGREPPASYYAPRTAREPAYPAAALYPAHGAADTAYPYGYRGGASPGRPPQPEQPPAQAKGPAHGLHASHVLQPQPPPPLQPRAVPPAAPRRCEAAPATPGVPAGGSAPACPLLLADKSPLGLKGKEPVVYPWMKKIHVSAGTWRRLGGAGGGPGLGLGSRVGVRRERLRGRGPREGSPHLARAAVRCGYVRASQPPDPNMRTLLYPGSLYQEIYETPNCEGSNYSPHKFNCPGRGFRPCVFEAFLQPQCPAPFFMALGCFPLSIACETFSLPFYVSCVNLVSGYYIMMMSNCSSPPHLLSPPPFPLFRSLLLGLLFRGSGFSVNPSYNGGEPKRSRTAYTRQQVLELEKEFHFNRYLTRRRRIEIAHTLCLSERQVKIWFQNRRMKWKKDHKLPNTKMRSSNSASASAGPPGKAQTQSPHLHPHPHPSTSTPVPSSI

SEQ ID NO: 802361 - protein, 174 aa, Homo sapiens
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKGSPKLANEPWNESGKVARRINGKRDRQHAENRAKRQL

SEQ ID NO: 802362 - protein, 465 aa, Homo sapiens
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKEKLQKAVTKLKQLEDRCTEQKLSTAMRITKWKEKVQIQRQKIRSDFKNLQCFLHEEEKSYLWRLEKEEQQTLSRLRDYEAGLGLKSNELKSHILELEEKCQGSAQKLLQNVNDTLSRSWAVKLETSEAVSLELHTMCNVSKLYFDVKKMLRSHQVSVTLDPDTAHHELILSEDRRQVTRGYTQENQDTSSRRFTAFPCVLGCEGFTSGRRYFEVDVGEGTGWDLGVCMENVQRGTGMKQEPQSGFWTLRLCKKKGYVALTSPPTSLHLHEQPLLVGIFLDYEAGVVSFYNGNTGCHIFTFPKASFSDTLRPYFQVYQYSPLFLPPPGD

SEQ ID NO: 802363 - protein, 193 aa, Homo sapiens
MCNVSKLYFDVKKMLRSHQVSVTLDPDTAHHELILSEDRRQVTRGYTQENQDTSSRRFTAFPCVLGCEGFTSGRRYFEVDVGEGTGWDLGVCMENVQRGTGMKQEPQSGFWTLRLCKKKGYVALTSPPTSLHLHEQPLLVGIFLDYEAGVVSFYNGNTGCHIFTFPKASFSDTLRPYFQVYQYSPLFLPPPGD

SEQ ID NO: 802364 - protein, 465 aa, Homo sapiens; identical to SEQ ID NO: 802362

SEQ ID NO: 802365 - protein, 465 aa, Homo sapiens; identical to SEQ ID NO: 802362

SEQ ID NO: 802366 - protein, 193 aa, Homo sapiens; identical to SEQ ID NO: 802363

SEQ ID NO: 802367 - protein, 465 aa, Homo sapiens; identical to SEQ ID NO: 802362

SEQ ID NO: 802368 - protein, 465 aa, Homo sapiens; identical to SEQ ID NO: 802362

SEQ ID NO: 802369 - protein, 459 aa, Homo sapiens
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKEKLQKAVTKLKQLEDRCTEQKLSTAMRITKWKEKVQIQRQKIRSDFKNLQCFLHEEEKSYLWRLEKEEQQTLSRLRDYEAGLGLKSNELKSHILELEEKCQGSAQKLLQNVNDTLSRSWAVKLETSEAVSLELHTMCNVSKLYFDVKKMLRSHQVSVTLDPDTAHHELILSEDRRQVTRGYTQENQDTSSRRFTAFPCVLGCEGFTSGRRYFEVDVGEGTGWDLGVCMENVQRGTGMKQEPQSGFWTLRLCKKKGYVALTSPPTSLHLHEQPLLVGILAATSLLSRRLPSLILSGPISRFINILLCFCLPQVTKEKSRSSLV

SEQ ID NO: 802370 - protein, 497 aa, Homo sapiens
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKEKLQKAVTKLKQLEDRCTEQKLSTAMRITKWKEKVQIQRQKIRSDFKNLQCFLHEEEKSYLWRLEKEEQQTLSRLRDYEAGLGLKSNELKSHILELEEKCQGSAQKLLQNVNDTLSRYVLFECRRGGVCVYRNEWNAPLKKSLASAYSRSWAVKLETSEAVSLELHTMCNVSKLYFDVKKMLRSHQVSVTLDPDTAHHELILSEDRRQVTRGYTQENQDTSSRRFTAFPCVLGCEGFTSGRRYFEVDVGEGTGWDLGVCMENVQRGTGMKQEPQSGFWTLRLCKKKGYVALTSPPTSLHLHEQPLLVGIFLDYEAGVVSFYNGNTGCHIFTFPKASFSDTLRPYFQVYQYSPLFLPPPGD

SEQ ID NO: 802371 - protein, 465 aa, Homo sapiens; identical to SEQ ID NO: 802362

SEQ ID NO: 802372 - protein, 465 aa, Homo sapiens; identical to SEQ ID NO: 802362

SEQ ID NO: 802373 - protein, 309 aa, Homo sapiens
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKEKLQKAVTKLKQLEDRCTEQKLSTAMRITKWKEKVQIQRQKIRSDFKNLQCFLHEEEKSYLWRLEKEEQQTLSRLRDYEAGLGLKSNELKSHILELEEKCQGSAQKLLQNVNDTLSRSWAVKLETSEAVSLELHTMCNVSKLYFDVKKMLRSHQGMFTKEFLNTVDRRGLMQ

SEQ ID NO: 802374 - protein, 453 aa, Homo sapiens
AGGLLRWLSPAPMDAPPGGVESALSCFSFNQDCTSLAIGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 802375 - protein, 111 aa, Homo sapiens
MASSVLDDLCESRLDISPPSVDHSNSYLAYPGSLTSGEIVLYDGNSLKTVCTIAAHEGTLAAITFNASGSKLASASEKGTVIRVFSVPDGQKLYEFRRGMKRQLSSLTAGR

SEQ ID NO: 802376 - protein, 446 aa, Homo sapiens
MEAEAADAPPGGVESALSCFSFNQDCTSLAIGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 802377 - protein, 227 aa, Homo sapiens [sequence omitted]

SEQ ID NO: 802378 - protein, 318 aa, Homo sapiens
MKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 802379 - protein, 353 aa, Homo sapiens
KASSGRTGKNGMVDRESNRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 802380 - protein, 104 aa, Homo sapiens
MMISFFFHLLLIVTSSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 802381 - protein, 437 aa, Homo sapiens [sequence omitted]

SEQ ID NO: 802382 - protein, 446 aa, Homo sapiens; identical to SEQ ID NO: 802376

SEQ ID NO: 802383 - protein, 358 aa, Homo sapiens
MEAEAADAPPGGVESALSCFSFNQDCTSLAIGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHR

SEQ ID NO: 802384 - protein, 325 aa, Homo sapiens
MEAEAADAPPGGVESALSCFSFNQDCTSLAIGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTYVQ

SEQ ID NO: 802385 - protein, 86 aa, Homo sapiens
PVHYSQSTRRAFDLEWLHGKDVYGCYQLPPYPGVRHDASGQGFCHCTLELLRTEEHLYPLNVRTMTPTLNKTTLSSMYFSKAQKSP

SEQ ID NO: 802386 - protein, 449 aa, Homo sapiens
DRRPGPWSRRGRAAEVAVAGSELRLPGPSPRWRPRPRTLPRAGLSRRSAASLSTRTAHEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 802387 - protein, 131 aa, Homo sapiens
MFSLALRIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 802388 - protein, 437 aa, Homo sapiens [sequence omitted]

SEQ ID NO: 802389 - protein, 437 aa, Homo sapiens [sequence omitted]

SEQ ID NO: 802390 - protein, 240 aa, Homo sapiens
MEAEAADAPPGGVESALSCFSFNQDCTSLAIGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRQLSSLTAGR

SEQ ID NO: 802391 - protein, 121 aa, Homo sapiens
MSLTFRRPKTLRLRRQPRYPRKSTPRRNKLGHYAIIKFPLATESAVKKIEENNTLVFTVDVKANKHQIRQAVKKLYDSDVAKVTTLICPDKENKAYVRLAPDYDAFDVVTKLGSPKLSPAG

SEQ ID NO: 802392 - protein, 121 aa, Homo sapiens; identical to SEQ ID NO: 802391

SEQ ID NO: 802393 - protein, 81 aa, Homo sapiens
RGAWREGRRECACGRVRDWGSWLWVWYRGFSGCRPPRGSGAVREPTTRFASLRPARRLLHTCRSHAGGLDSEGREVDLGDI

SEQ ID NO: 802394 - protein, 81 aa, Homo sapiens; identical to SEQ ID NO: 802393

SEQ ID NO: 802395 - protein, 130 aa, Homo sapiens
SNQRDSVGVGPSEPHAGYNLPVCRFLSPLEKRSIRVGVTRFSRCRLSPLSLTRKGNSLTPCASRVRQCLALLQLVHGALHPLSCAPCLALPSEMNPQMEMQKSPVFCVAHAGSCRPELFLLGHLGSTTLR

SEQ ID NO: 802396 - protein, 121 aa, Homo sapiens; identical to SEQ ID NO: 802391

SEQ ID NO: 802397 - protein, 121 aa, Homo sapiens; identical to SEQ ID NO: 802391

SEQ ID NO: 802398 - protein, 74 aa, Homo sapiens
RGAWREGRRECACGRVRDWGSWLWVWYRGFSGCRPPRGSGAVRNSKRTLCMNNLFPHYRVGNKQISKNNSASLQ

SEQ ID NO: 802399 - protein, 77 aa, Homo sapiens
APLAPPFCGVFGRGSRECKPRGRWGPEGLRRRIPRMKNYSQSCKGEESLLCWWEDQLFPYFLESSLTQCMKSKNLSH

SEQ ID NO: 802400 - protein, 159 aa, Homo sapiens [sequence omitted]

SEQ ID NO: 802401 - protein, 159 aa, Homo sapiens [sequence omitted]

SEQ ID NO: 802402 - protein, 345 aa, Homo sapiens
AAGQQPNGPGESWLPTGPGIGPAGLCWACGVSGCCSHGWWSGGPRSGAGGWHEMPYATGTPVGRQFLHEKCQTWVQVHLQGLQKVVFRSWQQAAAHQRCTVTRPEQLLLQSYFQAWCEVVRDTGVLRAQHQAFQDGLRRRALGAVFATWREAQEVAAGAQEQRVAQASLARWRSCGQQGQEDGQQQKARAPQAFPAWPVAPGMHHEAQQQAGESAGAQAAQCWTWCWALWVHESCRGQVSRAHASWKPRAWVLEASVQSAVRGGVQRAILTQLRPAELRRFLRTVQLRVRLGLPGAGKTRSCWTQATELVPPAPSLQCSLGGRRKPRGTAWAQSKETLPRGTNGV

SEQ ID NO: 802403 - protein, 322 aa, Homo sapiens [sequence omitted]

SEQ ID NO: 802404 - protein, 124 aa, Homo sapiens
EAVADELADAAQGQLLLRALQDGHGDERDVRVWTNPPRFNFQENRRRSGWRRRGCVANARGVQGRLVGSRKSLPGVAGTRNPIPVCPLRPGRGAPASPEEGARGEEFREEIISEIFAEDAGMWI

SEQ ID NO: 802405 - protein, 444 aa, Homo sapiens
AGKSIRAFASPPCPPGWRVAYATVTGLLGRSRASEGCERSCSMHTTESKNEHLEDENFQTSTTPQSLIDPNNTAHEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGKNN

SEQ ID NO: 802406 - protein, 489 aa, Homo sapiens
AGKSIRAFASPPCPPGWRVAYATVTGLLGRSRASEGCERSCSMHTTESKNEHLEDENFQTSTTPQSLIDPNNTAHEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGCVRSSGSRNSKSLRTPLGTICEGCDDSSIFSHLDHSSKWSSTYGHSGA

SEQ ID NO: 802407 - protein, 500 aa, Homo sapiens
AGKSIRAFASPPCPPGWRVAYATVTGLLGRSRASEGCERSCSMHTTESKNEHLEDENFQTSTTPQSLIDPNNTAHEETKTVLSDTEEIKPQTKKETYISCPLRGVLNVIITNGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 802408 - protein, 537 aa, Homo sapiens
SAGTPRDYGISRASEGCERSCSMHTTESKNEHLEDENFQTSTTPQSLIDPNNTAHEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 802409 - protein, 514 aa, Homo sapiens
AGKSIRAFASPPCPPGWRVAYATVTGLLGRSRASEGCERSCSMHTTESKNEHLEDENFQTSTTPQSLIDPNNTAHEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 802410 - protein, 557 aa, Homo sapiens
AGKSIRAFASPPCPPGWRVAYATVTGLLGRSRASEGCERSCSMHTTESKNEHLEDENFQTSTTPQSLIDPNNTAHEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 802411 - protein, 115 aa, Homo sapiens
AGKSIRAFASPPCPPGWRVAYATVTGLLGRSRASEGCERSCSMHTTESKNEHLEDENFQTSTTPQSLIDPNNTAHEETKTVLSDTEEIKPQTKKETYISCPLRGVLNVIITNVLF

SEQ ID NO: 802412 - protein, 448 aa, Homo sapiens
ARGSAGPSVHNGESRRRSPSPTQCGARREPRRKLSASARQARRRRAMYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYSIRMLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 802413 - protein, 235 aa, Homo sapiens
ARGSAGPSVHNGESRRRSPSPTQCGARREPRRKLSASARQARRRRAMYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNSFVVWKIFRQFK

SEQ ID NO: 802414 - protein, 152 aa, Homo sapiens
MKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 802415 - protein, 448 aa, Homo sapiens; identical to SEQ ID NO: 802412

SEQ ID NO: 802416 - protein, 183 aa, Homo sapiens
ARGSAGPSVHNGESRRRSPSPTQCGARREPRRKLSASARQARRRRAMYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFEKSSSHKCIYDAF

SEQ ID NO: 802417 - protein, 188 aa, Homo sapiens
ARGSAGPSVHNGESRRRSPSPTQCGARREPRRKLSASARQARRRRAMYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFASLCGRSSDNSSDQDFKI

SEQ ID NO: 802418 - protein, 204 aa, Homo sapiens
DAWSTHASGRVQKGFSNPGLTSRWKKYIAVRKPLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 802419 - protein, 339 aa, Homo sapiens
MDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAERKEPLRCLIKFSSPHLLEALKSLAPAGIADAPLSPLLTCIPNKRMNYFKIRDK

SEQ ID NO: 802420 - protein, 353 aa, Homo sapiens [sequence omitted]

SEQ ID NO: 802421 - protein, 198 aa, Homo sapiens
MDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMKQFKNSFKKILQRALKNVTVSFRETEENAVWIRIAWGTQYTKPNQYKPTYVVYYSQTPYAFTSSSMLRRNTPLLGQRLTIGLENTIRLVNGPEKLGF

SEQ ID NO: 802422 - protein, 126 aa, Homo sapiens
MEFFSRHQKSLGMFFQIEKRAQGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSR

SEQ ID NO: 802423 - protein, 223 aa, Homo sapiens
YWWCLRRSETAGDVGRAKEMDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMKQFKNSFKKILQRALKNVTVSFRETEENAVWIRIAWGTQYTKPNQYKPTYVVYYSQTPYAFTSSSMLRRNTPLLGQELEATGKIYLRQEEIILDITEMKKACN

SEQ ID NO: 802424 - protein, 271 aa, Homo sapiens
ALSHPVPLQQRSKVWDFLQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAERKEPLRCLIKFSSPHLLEALKSLAPAGIADAPLSPLLTCIPNKRMNYFKIRDK

SEQ ID NO: 802425 - protein, 293 aa, Homo sapiens
MDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMKQFKNSFKKILQRALKNVTVSFRETEENAVWIRIAWGTQYTKPNQYKPTYVVYYSQTPYAFTSSSMLRRNTPLLGQWRWGFAMLPRLVSNSRLQVILSLPKCWDRHELTVPHLGLTYSNSEMITKRKNRLPALIFFKVPKENRNQPISIRMATAEKKQKITNAKEDMEKLKLLRTVGGHVNWDSHCGNRYSS

SEQ ID NO: 802426 - protein, 204 aa, Homo sapiens
MDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMKQFKNSFKKILQRALKNVTVSFRETEENAVWIRIAWGTQYTKPNQYKPTYVVYYSQTPYAFTSSSMLRRNTPLLGQELEATGKIYLRQEEIILDITEMKKACN

SEQ ID NO: 802427 - protein, 287 aa, Homo sapiens
MDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAER

SEQ ID NO: 802428 - protein, 128 aa, Homo sapiens
ALSHPVPLQQRSKVWDFLQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSR

SEQ ID NO: 802429 - protein, 204 aa, Homo sapiens; identical to SEQ ID NO: 802426

SEQ ID NO: 802430 - protein, 196 aa, Homo sapiens
MDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSR

SEQ ID NO: 802431 - protein, 312 aa, Homo sapiens
YWWCLRRSETAGDVGRAKEMDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMKQFKNSFKKILQRALKNVTVSFRETEENAVWIRIAWGTQYTKPNQYKPTYVVYYSQTPYAFTSSSMLRRNTPLLGQWRWGFAMLPRLVSNSRLQVILSLPKCWDRHELTVPHLGLTYSNSEMITKRKNRLPALIFFKVPKENRNQPISIRMATAEKKQKITNAKEDMEKLKLLRTVGGHVNWDSHCGNRYSS

SEQ ID NO: 802432 - protein, 98 aa, Homo sapiens
EDVVGVRRDASVTPLNVPRHVLPDQLDAGADAVGPWTRAGQDGKYRCLEQRGREEAHGPSLLRVPPALRPSVLKVKALPVLRYPLLPSHLASSLCFPP

SEQ ID NO: 802433 - protein, 150 aa, Homo sapiens
LLPPHPHQQMHRDEEDSDVDVTFQPWHKEMLQQLLVMLSSTVATRPQKAACPHQESQSHGPPKESRPSIQLPRTGSLLPQLSDITPYQPGDLGLVPRQVHIPPNPQDLRLLSSITRVGTFRAHSSPEMRAPGSLKRLEKFSLPEVPLRPK

SEQ ID NO: 802434 - protein, 71 aa, Homo sapiens
LLPPHPHQQMHRDEEDSDVDVTFQPWHKEMLQQLLVMLSSTVATRPQKAACPHQESQSHGPPKERCVPLVL

SEQ ID NO: 802435 - protein, 155 aa, Homo sapiens
LLPPHPHQQMHRDEEDSDVDVTFQPWHKEMLQQLLVMLSSTVATRPQKAACPHQESQSHGPPKESRPSIQLPRTGSLLPQLSDITPYQPGDLGLVPRQVHIPPNPQDLRLLSSITRVGTFRAHSSPERPVGPNAEERKRRATLQWGRGAKKGPRN

SEQ ID NO: 802436 - protein, 89 aa, Homo sapiens
MGTVLGSPWARNLARRRLCDPRPPPHSRPSIQLPRTGSLLPQLSDITPYQPGDLGLVPRQVHIPPNPQDLRLLSSITRVGTFRAHSSPE

SEQ ID NO: 802437 - protein, 131 aa, Homo sapiens
WVARTSGPQPSALSRGPLTSLLKGGGSVATVLLGQALSGRGGEELSAVAHPTLRAGTEWATPRARLHAGSARLEAALQGARRNPGDSAERAETELTKGLAAAERGSRHSGYLTETSNPRRYKALHRRQSTT

SEQ ID NO: 802438 - protein, 131 aa, Homo sapiens; identical to SEQ ID NO: 802437

SEQ ID NO: 802439 - protein, 91 aa, Homo sapiens
SRPGTRRPLGSSQPASSSQAIAGLPAARVPASAVSHRAHRSPAPGSSPQGYGQIGPWFWNGESVAPNRRLNVTRRKDPLQDPVPLPRFISC

SEQ ID NO: 802440 - protein, 327 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 802441 - protein, 327 aa, Homo sapiens; identical to SEQ ID NO: 802440

SEQ ID NO: 802442 - protein, 325 aa, Homo sapiens
MESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 802443 - protein, 122 aa, Homo sapiens
MESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRREV

SEQ ID NO: 802444 - protein, 234 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQGTQKL

SEQ ID NO: 802445 - protein, 341 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 802446 - protein, 313 aa, Homo sapiens [sequence omitted]

SEQ ID NO: 802447 - protein, 327 aa, Homo sapiens; identical to SEQ ID NO: 802440

SEQ ID NO: 802448 - protein, 341 aa, Homo sapiens; identical to SEQ ID NO: 802445

SEQ ID NO: 802449 - protein, 287 aa, Homo sapiens
MPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 802450 - protein, 138 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRREV

SEQ ID NO: 802451 - protein, 248 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQGTQKL

SEQ ID NO: 802452 - protein, 280 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNR

SEQ ID NO: 802453 - protein, 691 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVRTPESFIVVEEAGEFSPNVPKSLSSAVKVKIGTSLEWGGTSEPKKFDDSVILRPSKSVKLRSPKSGKNFSWL

SEQ ID NO: 802454 - protein, 807 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVRTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 802455 - protein, 640 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVRTPESFIVVEEAGEYSSVSIK

SEQ ID NO: 802456 - protein, 807 aa, Homo sapiens; identical to SEQ ID NO: 802454

SEQ ID NO: 802457 - protein, 179 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKEAEKRKSDYIIRTLKVKFNSVSVILAHQTSLQNLFSQITPAHF

SEQ ID NO: 802458 - protein, 621 aa, Homo sapiens
FGVRPGCCSGDQLVSLGGRCFPRPPGAMIQNVGNHLRRGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKVSYYNQATPGVLNYVTTNVAGLSSEFYTTFKACEQFLLDNRNDLAPSLQTL

SEQ ID NO: 802459 - protein, 102 aa, Homo sapiens
LTLQDLHCELGFQLQHKVGIQVASEDLCSEKQWNVCKALATFVARREITKVKLKQITPRTEEEKMEHSVAAERRRMRLVYADTIKDLLANCAIQGGEQLPAV

SEQ ID NO: 802460 - protein, 645 aa, Homo sapiens
MIQNVGNHLRRLSLEGEIAEPLGWFIISSNLQTSPRGCQIPHGLAVESGITFSKCRPLEFYSGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKVSYYNQATPGVLNYVTTNVAGLSSEFYTTFKACEQFLLDNRNDLAPSLQTL

SEQ ID NO: 802461 - protein, 621 aa, Homo sapiens; identical to SEQ ID NO: 802458

SEQ ID NO: 802462 - protein, 634 aa, Homo sapiens
FGVRPGCCSGDQLVSLGGRCFPRPPGAMIQNVGNHLRRGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKCCWVRVSLTELVSASGFYSWGLESRSKGRRSDGWNGKLAGGHLSTLKAIPVAKINSRFGYLQDT

SEQ ID NO: 802463 - protein, 170 aa, Homo sapiens
GPRRPVSEPLPADSLPGRPQRAPLASALHAAGAEPPILWGLASVFSNRTSRKSALRAGNDSAMADGEGYRNPTEVQMSQLVLPCHTNQRGELSVGQLLKWIDTTACLSAERHAGCPCVTASMDDIYFEHTIRCRTSGEYQGQRRTRGLTKSRHGKVGNTKVRQQEGPWSI

SEQ ID NO: 802464 - protein, 578 aa, Homo sapiens
GPRRPVSEPLPADSLPGRPQRAPLASALHAAGAEPPILWGLASVFSNRTSRKSALRAGNDSAMADGEGYRNPTEVQMSQLVLPCHTNQRGELSVGQLLKWIDTTACLSGGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKVSYYNQATPGVLNYVTTNVAGLSSEFYTTFKACEQFLLDNRNDLAPSLQTL

SEQ ID NO: 802465 - protein, 1205 aa, Homo sapiens
MVLLSLWLIAAALVEVRTSADGQAGNEEMVQIDLPIKRYREYELVTPVSTNLEGRYLSHTLSASHKKRSARDVSSNPEQLFFNITAFGKDFHLRLKPNTQLVAPGAVVEWHETSLVPGNITDPINNHQPGSATYRIRKTEPLQTNCAYVGDIVDIPGTSVAISNCDGLAGMIKSDNEEYFIEPLERGKQMEEEKGRIHVVYKRSAVEQAPIDMSKDFHYRESDLEGLDDLGTVYGNIHQQLNETMRRRRHAGENDYNIEVLLGVDDSVVRFHGKEHVQNYLLTLMNIVNEIYHDESLGVHINVVLVRMIMLGYAKSISLIERGNPSRSLENVCRWASQQQRSDLNHSEHHDHAIFLTRQDFGPAGMQGYAPVTGMCHPVRSCTLNHEDGFSSAFVVAHETGHVLGMEHDGQGNRCGDETAMGSVMAPLVQAAFHRYHWSRCSGQELKRYIHSYDCLLDDPFDHDWPKLPELPGINYSMDEQCRFDFGVGYKMCTAFRTFDPCKQLWCSHPDNPYFCKTKKGPPLDGTECAAGKWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIDLIIPQENDTRSSLTYKYIIHEDSVPTINSNNVIQEELDTFEWALKSWSQCSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 802466 - protein, 163 aa, Homo sapiens
LVTPVSTNLEGRYLSHTLSASHKKRSARDVSSNPEQLFFNITAFGKDFHLRLKPNTQLVAPGAVVEWHETSLVPGNITDPINNHQPGSATYRIRKTEPLQTNCAYVGDIVDIPGTSVAISNCDGLVRLLLFCAYVCRCWECSHGFCIVWKVEVERRLHCYVTF

SEQ ID NO: 802467 - protein, 546 aa, Homo sapiens
MKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIVLIIPQENDTRSSLTYKYIIHEDSVPTINSNNVIQEELDTFEWALKSWSQCSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 802468 - protein, 91 aa, Homo sapiens
ACLASRPPLPQRYPLRTLTRCSSVLAESAQNVAGPKGLFTTLAGVSICCATTFISGEINPIYLLASPWRTVSSDKKQPIYLLQPDPTSPDA

SEQ ID NO: 802469 - protein, 85 aa, Homo sapiens
ACLASRPPLPQRYPLRTLTRCSSVLAESAQNVAGPKGLFTTLAGVSICCATTFISGEINPIYLLASPWRTVSSDKSTLNWNLELD

SEQ ID NO: 802470 - protein, 131 aa, Homo sapiens
QIKGRGGGEREKEESRLSNMKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 802471 - protein, 132 aa, Homo sapiens
AASSTLGFRVPRPEMGSKAKKRVLLPTRPAPPTVEQILEDVRGAPAEDPVFTILAPEDPPVPFRMMEDAEAPGEQLYQQSRAYVAANQRLQQAGNVLRQRCELLQRAGEDLEREVAQMKQAALPAAEAASSG

SEQ ID NO: 802472 - protein, 132 aa, Homo sapiens; identical to SEQ ID NO: 802471

SEQ ID NO: 802473 - protein, 118 aa, Homo sapiens
MGSKAKKRVLLPTRPAPPTVEQILEDVRGAPAEDPVFTILAPEDPPVPFRMMEDAEAPGEQLYQQSRAYVAANQRLQQAGNVLRQRCELLQRAGEDLEREVAQMKQAALPAAEAASSG

SEQ ID NO: 802474 - protein, 108 aa, Homo sapiens
MLLKLLTWPREVPAVSQGGRWGGGRLLPSLPTLHFCAACSHSFPCPPSWARAVLPEVALTWGRPSSRSPCPPLTLPGSGCCGCPIPAVAPATAPSGSWVPPAPHWGLP

SEQ ID NO: 802475 - protein, 145 aa, Homo sapiens
MGSKAKKRVLLPTRPAPPTVEQILEDVRGAPAEDPVFTILAPEEGRGSPVPGKSGPETPAARGRERSTPLTPDPTPWEPPQHGHGPYPLRVSLYSSVEWDRFSEGSSDRGGGRALWFRPVSPALSEDEAGGSLEPRSSRPAWPTW

SEQ ID NO: 802476 - protein, 132 aa, Homo sapiens; identical to SEQ ID NO: 802471

SEQ ID NO: 802477 - protein, 88 aa, Homo sapiens
AASSTLGFRVPRPEMGSKAKKRVLLPTRPAPPTVEQILEDVRGAPAEDPVFTILAPEDCTPAWATEQDPVCLKRNEALKQTDYGVGAP

SEQ ID NO: 802478 - protein, 155 aa, Homo sapiens
RERDRDGCVRVRWAGGAARARAERWTPRSAPPSPPSEMGSKAKKRVLLPTRPAPPTVEQILEDVRGAPAEDPVFTILAPEDPPVPFRMMEDAEAPGEQLYQQSRAYVAANQRLQQAGNVLRQRCELLQRAGEDLEREVAQMKQAALPAAEAASSG

SEQ ID NO: 802479 - protein, 107 aa, Homo sapiens
ETMRRRGALRAGTRVFSTLAVGKQQAAWTTVAELGWKGFPSIAQLLYKNMARLFAKICERSVGFQSCFSFLGGTSQLGSPATPASQSFETSLGLSFQKEGQAAIFAV

SEQ ID NO: 802480 - protein, 358 aa, Homo sapiens
MKTAENIRGTGSDGPRKRGLCVLCGLPAAGKSTFARALAHRLQQEQGWAIGVVAYDDVMPDAFLAGARARPAPSQWKLLRQELLKYLEYFLMAVINGCQMSVPPNRTEAMWEDFITCLKDQDLIFSAAFEAQSCYLLTKTAVSRPLFLVLDDNFYYQSMRYEVYQLARKYSLGFCQLFLDCPLETCLQRNGQRPQALPPETIHLMGRKLEKPNPEKNAWEHNSLTIPSPACASEASLEVTDLLLTALENPVKYAEDNMEQKDTDRIICSTNILHKTDQTLRRIVSQTMKEAKDEQVLPHNLKLLAEELNKLKAEFLEDLKQGNKKYLCFQQTIDIPDVISFFHYEKDNIVQKYFSKQH

SEQ ID NO: 802481 - protein, 358 aa, Homo sapiens; identical to SEQ ID NO: 802480

SEQ ID NO: 802482 - protein, 358 aa, Homo sapiens; identical to SEQ ID NO: 802480

SEQ ID NO: 802483 - protein, 238 aa, Homo sapiens
MKTAENIRGTGSDGPRKRGLCVLCGLPAAGKSTFARALAHRLQQEQGWAIGVVAYDDVMPDAFLAGARARPAPSQWKLLRQELLKYLEYFLMAVINGCQMSVPPNRTEAMWEDFITCLKDQDLIFSAAFEAQSCYLLTKTAVSRPLFLVLDDNFYYQSMRYEVYQLARKYSLGFCQLFLDCPLETCLQRNGQRPQALPPETIHLMGRKLEKPTLRKMLGNTTASQFRVQHVLRRPAWK

SEQ ID NO: 802484 - protein, 348 aa, Homo sapiens
MKTAENIRGTGSDGPRKRGLCVLCGLPAAGKSTFARALAHRLQQEQGWAIGVVAYDDVMPDAFLAGARARPAPSQWKLLRQELLKYLEYFLMAVINGCQMSVPPNRTEAMWEDFITCLKDQDLIFSAAFEAQSCYLLTKTAVSRPLFLVLDDNFYYQSMRYEVYQLARKYSLGFCQLFLDCPLETCLQRNGQRPQALPPETIHLMGRKLEKPNPEKNAWEHNSLTIPSPACASEASLEVTDLLLTALENPVKYAEDNMEQKDTDRIICSTNILHKTDQTLRRIVSQTMKEAKGNQEAFSEMTFKQRWVRANHAAIWRIILGNEHIKCRSAKVGWLQCCRIEKRPLSTG

SEQ ID NO: 802485 - protein, 135 aa, Homo sapiens
MEFSDAMSFGVRTVVKVRPAPRPPTGRWQTPWSHRTAVCPSGERREAMAKEGMLGGQRGVPTHGQQEKKRGQCNHGGRDWRDVATSQALPAATRNRNRQRRDSPPEPPEEYSPADTLVLAQESRFGLLASRTVRK

SEQ ID NO: 802486 - protein, 118 aa, Homo sapiens [sequence omitted]

SEQ ID NO: 802487 - protein, 1281 aa, Homo sapiens
MVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 802488 - protein, 825 aa, Homo sapiens
NEEQLEDDETGTCTTIPRTSTGNGIVKASTYAAAEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 802489 - protein, 1281 aa, Homo sapiens
MVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSFPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 802490 - protein, 674 aa, Homo sapiens
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGGKRVGSGAQKTRTGRLKKPFVKVEDMSQLYRPFYLQLTNMPFINYSIQKPCSPFDVDKPSSMQKQTQVKLRIQTDGDKYGGTSIQLQLKEKKKKGYCECCLQKYEDLETHLLSEQHRNFAQSNQYQVVDDIVSKLVFDFVEYEKDTPKKKRIKYSVGSLSPVSASVLKKTEQKEKVELQHISQKDCQEDDTTVKEQNFLYKETQETEKKLLFISEPIPHPSNELRGLNEKMSNKCSMLSTAEDDIRQNFTQLPLHKNKQECILDISEHTLSENDLEELRVDHYKCNIQASVHVSDFSTDNSGSQPKQKSDTVLFPAKDLKEKDLHSIFTHDSGLITINSSQEHLTVQAKAPFHTPPEEPNECDFKNMDSLPSGKIHRKVKIILGRNRKENLEPNAEFDKRTEFITQEENRICSSPVQSLLDLFQTSEEKSEFLGFTSYTEKSGICNVLDIWEEENSDNLLTAFFSSPSTSTFTGF

SEQ ID NO: 802491 - protein, 674 aa, Homo sapiens; identical to SEQ ID NO: 802490

SEQ ID NO: 802492 - protein, 626 aa, Homo sapiens
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGKPCSPFDVDKPSSMQKQTQVKLRIQTDGDKYGGTSIQLQLKEKKKKGYCECCLQKYEDLETHLLSEQHRNFAQSNQYQVVDDIVSKLVFDFVEYEKDTPKKKRIKYSVGSLSPVSASVLKKTEQKEKVELQHISQKDCQEDDTTVKEQNFLYKETQETEKKLLFISEPIPHPSNELRGLNEKMSNKCSMLSTAEDDIRQNFTQLPLHKNKQECILDISEHTLSENDLEELRVDHYKCNIQASVHVSDFSTDNSGSQPKQKSDTVLFPAKDLKEKDLHSIFTHDSGLITINSSQEHLTVQAKAPFHTPPEEPNECDFKNMDSLPSGKIHRKVKIILGRNRKENLEPNAEFDKRTEFITQEENRICSSPVQSLLDLFQTSEEKSEFLGFTSYTEKSGICNVLDIWEEENSDNLLTAFFSSPSTSTFTGF

SEQ ID NO: 802493 - protein, 414 aa, Homo sapiens
MQKQTQVKLRIQTDGDKYGGTSIQLQLKEKKKKGYCECCLQKYEDLETHLLSEQHRNFAQSNQYQVVDDIVSKLVFDFVEYEKDTPKKKRIKYSVGSLSPVSASVLKKTEQKEKVELQHISQKDCQEDDTTVKEQNFLYKETQETEKKLLFISEPIPHPSNELRGLNEKMSNKCSMLSTAEDDIRQNFTQLPLHKNKQECILDISEHTLSENDLEELRVDHYKCNIQASVHVSDFSTDNSGSQPKQKSDTVLFPAKDLKEKDLHSIFTHDSGLITINSSQEHLTVQAKAPFHTPPEEPNECDFKNMDSLPSGKIHRKVKIILGRNRKENLEPNAEFDKRTEFITQEENRICSSPVQSLLDLFQTSEEKSEFLGFTSYTEKSGICNVLDIWEEENSDNLLTAFFSSPSTSTFTGF

SEQ ID NO: 802494 - protein, 414 aa, Homo sapiens; identical to SEQ ID NO: 802493

SEQ ID NO: 802495 - protein, 674 aa, Homo sapiens; identical to SEQ ID NO: 802490

SEQ ID NO: 802496 - protein, 436 aa, Homo sapiens [sequence omitted]

SEQ ID NO: 802497 - protein, 415 aa, Homo sapiens
GGAGGPQAGGRRAQGADLLERGPRARGGVPARSQAGGGPRQAADSLRLREPQQDRPGGAIEGSPIPVLTVPTAPYEDQRPSGGGGLRRPTGLFEGQRNYLPNFIQSVLSSIDLRDRQGCTMVVGSDGRYFSRTAIEIVVQMAAANGIGGLIIGQNGILSTPAVSCIIRKIKAAGGIILTASHCPGGPGGEFGVKFNVANGGPAPDVVSDKIYQISKTIEEYAICPDLQIDLSRLGRQEFDLENKFKPFRVEIVDPVDIYLNLLQTIFDFHAIKSLLTGPSQLKIRVDAMHGVMEPYVRKVLCDELGAPANSAINCVPLEDFGGQHPDPNLTYAMTLLEAMKGGEYGFGAAFDADGDRYMILGQNGFFVSPSDSLAIIAANLSCIPYFHQMGVRGFGRSMPTSMALDRETSGDTIC

SEQ ID NO: 802498 - protein, 238 aa, Homo sapiens
MVRGWVAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802499 - protein, 201 aa, Homo sapiens
MGLRPMEGTFPHGIDILTTADYFAVGNRSNCFLVIRVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKMQQSRPCGATEMHKAT

SEQ ID NO: 802500 - protein, 300 aa, Homo sapiens
TGPWVENLDEVVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQSPGQSVPTFPGRSRESESGELRVRRGERPNGGACLGPGVYRGA

SEQ ID NO: 802501 - protein, 1192 aa, Homo sapiens [sequence omitted]

SEQ ID NO: 802502 - protein, 1192 aa, Homo sapiens [sequence omitted]

SEQ ID NO: 802503 - protein, 1303 aa, Homo sapiens
GQGAAGSWVCLTDTGHFLGLLLNVPELSAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQGLCVLIEKLSLSKMPFRGDTVIDGWQWLINDTLRHLQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802504 - protein, 725 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDIAVASRWPWAPFQASF

SEQ ID NO: 802505 - protein, 1192 aa, Homo sapiens [sequence omitted]

SEQ ID NO: 802506 - protein, 829 aa, Homo sapiens
APSPSRLPGLVSGWLGPSSEPSVPVFCGTAAAGSAARGRPGKAGLGAWVLQGSFTERLSGRSCSSEKLAVSPGGCLVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802507 - protein, 712 aa, Homo sapiens
MVCDPPSNAVRKVLQLVLSIGKEHGDSGSQCAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802508 - protein, 630 aa, Homo sapiens
MIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802509 - protein, 651 aa, Homo sapiens
MGLRPMEGTFPHGIDILTTADYFAVGNRSNCFLVIRVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802510 - protein, 1041 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTVRRRRAGWGRRWLQECLVLPCLLGACMELGLFFHCFLSLSGIFG

SEQ ID NO: 802511 - protein, 1041 aa, Homo sapiens; identical to SEQ ID NO: 802510

SEQ ID NO: 802512 - protein, 435 aa, Homo sapiens
MDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802513 - protein, 731 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQADLVIVPQMPPEHTVQGCHLSDVPMGARSCLLSGIKTIPHMSWTAGDLVALGV

SEQ ID NO: 802514 - protein, 218 aa, Homo sapiens
FSLEKCLHFFLFSFPDCCGLILPCHTCDLRVFSPCLSFHAPSGGLTLSSRPSISPCSLRHRFFWVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802515 - protein, 748 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKRPAASQMSAARGIVRVQCVPLQ

SEQ ID NO: 802516 - protein, 147 aa, Homo sapiens
MSSDTEIRIPGNDLPVRSGHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802517 - protein, 110 aa, Homo sapiens
GAHLEPCAAPGRFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802518 - protein, 517 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASWDPLEQ

SEQ ID NO: 802519 - protein, 104 aa, Homo sapiens
YPSSSASHEWGRGWVRGPQKLPLCTSPARHSSSKVTKTSTSVLTGAGAQGCCAVSLVTRVGSFLSASFRQEVISEREEENHVQIHGGSGDGLSIRTQPPPFLCV

SEQ ID NO: 802520 - protein, 542 aa, Homo sapiens
MFNSVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQPCICSWGLMSPESKAEFCVCVCRISLGRQCVHLSGLREILKGFCDPELYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTVRRRRAGWGRRWLQECLVLPCLLGACMELGLFFHCFLSLSGIFG

SEQ ID NO: 802521 - protein, 218 aa, Homo sapiens; identical to SEQ ID NO: 802514

SEQ ID NO: 802522 - protein, 273 aa, Homo sapiens
SGGSERTARGTDTGGRNHVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRSVIQGSGKDSHETSSVCLTRNSVPFQNAL

SEQ ID NO: 802523 - protein, 1192 aa, Homo sapiens [sequence omitted]

SEQ ID NO: 802524 - protein, 1230 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVDFPSATLACVGTVQMCAHTHLRLGAPGPHCAHGSALPRFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802525 - protein, 1239 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQPCICSWGLMSPESKAEFCVCVCRISLGRQCVHLSGLREILKGFCDPELYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802526 - protein, 1064 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEE

SEQ ID NO: 802527 - protein, 764 aa, Homo sapiens [sequence omitted]

SEQ ID NO: 802528 - protein, 678 aa, Homo sapiens
RNGQTGFESNCAEFPPTGSEFSFFRVSPPLHAVFSSVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802529 - protein, 678 aa, Homo sapiens
MGLRPMEGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802530 - protein, 468 aa, Homo sapiens [sequence omitted]

SEQ ID NO: 802531 - protein, 337 aa, Homo sapiens
MDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802532 - protein, 306 aa, Homo sapiens
CDLADPFCGCLSCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802533 - protein, 161 aa, Homo sapiens
TAPSPLRVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 802534 - protein, 742 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKMQQSRPCGATEMHKAT

SEQ ID NO: 802535 - protein, 798 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSESRSPRRSCVRRECFPDLLCAAGLHGRLHHGQQRGRGHLGPQGRHDQSDGSDTSAGSEPA

SEQ ID NO: 802536 - protein, 475 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVGTVILKALTYDEKRAPQQGPLDTRQNSVGPRPSPN

SEQ ID NO: 802537 - protein, 930 aa, Homo sapiens [sequence omitted]

SEQ ID NO: 802538 - protein, 808 aa, Homo sapiens
MLLGWASLLLCAFRLPLAAVGPAATPAQDKAGQPPTAAAAAQPRRRQGEEVQERAEPPGHPHPLAQRRRSKGLVQNIDQLYSGGGKVGYLVYAGGRRFLLDLERDGSVGIAGFVPAGGGTSAPWRHRSHCFYRGTVDASPRSLAVFDLCGGLDGFFAVKHARYTLKPLLRGPWAEEEKGRVYGDGSARILHVYTREGFSFEALPPRASCETPASTPEAHEHAPAHSNPSGRAALASQLLDQSALSPAGGSGPQTWWRRRRRSISRARQVELLLVADASMARLYGRGLQHYLLTLASIANRLYSHASIENHIRLAVVKVVVLGDKDKSLEVSKNAATTLKNFCKWQHQHNQLGDDHEEHYDAAILFTREDLCGHHSCDTLGMADVGTICSPERSCAVIEDDGLHAAFTVAHEIGHLLGLSHDDSKFCEETFGSTEDKRLMSSILTSIDASKPWSKCTSATITEFLDDGHGNCLLDLPRKQILGPEELPGQTYDATQQCNLTFGPEYSVCPGMDVCARLWCAVVRQGQMVCLTKKLPAVEGTPCGKGRICLQGKCVDKTKKKYYSTSSHGNWGSWGSWGQCSRSCGGGVQFAYRHCNNPAPRNNGRYCTGKRAIYHSCSLMPCPPNGKSFRHEQCEAKNGYQSDAKGVKTFVEWVPKYAGVLPADVCKLTCRAKGTGYYVVFSPKVTDGTECRPYSNSVCVRGKCVRTGCDGIIGSKLQYDKCGVCGGDNSSCTKIVGTFNKKSKGYTDVVRIPEGATHIKVRQFKAKDQTRFTAYLALKKKNEVGAAEAGNQSFILGTLAHAVCFLRPK

SEQ ID NO: 802539 - protein, 930 aa, Homo sapiens [sequence omitted]

SEQ ID NO: 802540 - protein, 408 aa, Homo sapiens
MSKRDIVLTNVTVVQLLRQPCPVTRAPPPPEPKAEVEPQPQPEPTPVREEIKPPPPPLPPHPATPPPKMVSVARELTVGINGFGRIGRLVLRACMEKGVKVVAVNDPFIDPEYMVYMFKYDSTHGRYKGSVEFRNGQLVVDNHEISVYQCKEPKQIPWRAVGSPYVVESTGVYLSIQAASDHISAGAQRVVISAPSPDAPMFVMGVNENDYNPGSMNIVSNASCTTNCLAPLAKVIHERFGIVEGLMTTVHSYTATQKTVDGPSRKAWRDGRGAHQNIIPASTGAAKAVTKVIPELKGKLTGMAFRVPTPDVSVVDLTCRLAQPAPYSAIKEAVKAAAKGPMAGILAYTEDEVVSTDFLGDTHSSIFDAKAGIALNDNFVKLISWYDNEYGYSHRVVDLLRYMFSRDK

SEQ ID NO: 802541 - protein, 395 aa, Homo sapiens
NPFPPFPRIVTRAPPPPEPKAEVEPQPQPEPTPVREEIKPPPPPLPPHPATPPPKMVSVARELTVGINGFGRIGRLVLRACMEKGVKVVAVNDPFIDPEYMVYMFKYDSTHGRYKGSVEFRNGQLVVDNHEISVYQCKEPKQIPWRAVGSPYVVESTGVYLSIQAASDHISAGAQRVVISAPSPDAPMFVMGVNENDYNPGSMNIVSNASCTTNCLAPLAKVIHERFGIVEGLMTTVHSYTATQKTVDGPSRKAWRDGRGAHQNIIPASTGAAKAVTKVIPELKGKLTGMAFRVPTPDVSVVDLTCRLAQPAPYSAIKEAVKAAAKGPMAGILAYTEDEVVSTDFLGDTHSSIFDAKAGIALNDNFVKLISWYDNEYGYSHRVVDLLRYMFSRDK

SEQ ID NO: 802542 - protein, 118 aa, Homo sapiens
MDYEGGAQAGETDSALPLPHSKEPKQIPWRAVGSPYVVESTGVYLSIQAASVSWGEVPRASWGDDGAKKPLTPALPPQDHISAGAQRVVISAPSPDAPMFVMGVNENDYNPGSMNIVR

SEQ ID NO: 802543 - protein, 110 aa, Homo sapiens
NLVSLEEDLKEGASRAQTMGNSLLKERAIYVLVRIISKRERTWPPPAMSPYWRTWMTITQSWQRNCAGCQASPLWATTGGSVWALGEAAMSKAPLQGPERALIKGMDCTL

SEQ ID NO: 802544 - protein, 303 aa, Homo sapiens
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTGHPYQNRTPPKKKNRGLTTRPKSLASRRWRRPASEPAHSALWDPRPTQGSLRPETQDSSPPSWPQTAPRRGTLPSHGPEGPPHLCRHCSPFGGRAQGTRTRAPLPEASRTCLNC

SEQ ID NO: 802545 - protein, 330 aa, Homo sapiens
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTGHPYQNRTPPKKKKPRTSFTRLQICELEKRFHRQKYLASAERAALAKALKMTDAQVKTWFQNRRTKWRRQTAEEREAERQQANRILLQLQQEAFQKSLAQPLPADPLCVHNSSLFALQNLQPWSDDSTKITSVTSVASACE

SEQ ID NO: 802546 - protein, 342 aa, Homo sapiens
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTVALSPFTVTRRIGHPYQNRTPPKKKKPRTSFTRLQICELEKRFHRQKYLASAERAALAKALKMTDAQVKTWFQNRRTKWRRQTAEEREAERQQANRILLQLQQEAFQKSLAQPLPADPLCVHNSSLFALQNLQPWSDDSTKITSVTSVASACE

SEQ ID NO: 802547 - protein, 321 aa, Homo sapiens
AKADSAIVPTRLGGGVRQRPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEEDLGLKAADARKDGIYVTWPHGRSGCSPGVQNTEAYNGDRAISGRVGPENWRREKGSYITHKVQGQTGAPDKPPGNPPKAP

SEQ ID NO: 802548 - protein, 757 aa, Homo sapiens
MGEPEAGSEFANGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802549 - protein, 737 aa, Homo sapiens
MADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802550 - protein, 740 aa, Homo sapiens
MVGGRVEIRRGANDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802551 - protein, 759 aa, Homo sapiens
MAGSSRGLNRHEANGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802552 - protein, 759 aa, Homo sapiens; identical to SEQ ID NO: 802551

SEQ ID NO: 802553 - protein, 451 aa, Homo sapiens
AKADSAIVPTRLGGGVRQRPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802554 - protein, 272 aa, Homo sapiens
NLEDPDSTEAVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802555 - protein, 503 aa, Homo sapiens
PWLDRGRGLNRHEANGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVIVGL

SEQ ID NO: 802556 - protein, 341 aa, Homo sapiens
LVINGDIYAVGRKTGIGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802557 - protein, 396 aa, Homo sapiens
PWLDRGRGLNRHEANGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTALSSLPIASPL

SEQ ID NO: 802558 - protein, 70 aa, Homo sapiens
SQSPNEWGSRKQEVSLRTEQLLQQGPWRTPSTSCPMTSACLAWTAVRQHFPACQLLPLCDLISSALPYVE

SEQ ID NO: 802559 - protein, 307 aa, Homo sapiens
KRSWYGLGCLDAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPISKLGARKASLSQSPAHGPYNPPARPKGPARTPRVPT

SEQ ID NO: 802560 - protein, 759 aa, Homo sapiens; identical to SEQ ID NO: 802551

SEQ ID NO: 802561 - protein, 761 aa, Homo sapiens
LVINGDIYAVGRKTGIGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802562 - protein, 510 aa, Homo sapiens
MAGSSRGLNRHEANGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQDLWL

SEQ ID NO: 802563 - protein, 759 aa, Homo sapiens; identical to SEQ ID NO: 802551

SEQ ID NO: 802564 - protein, 399 aa, Homo sapiens
MSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802565 - protein, 265 aa, Homo sapiens
GTLSPTVELLFQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 802566 - protein, 393 aa, Homo sapiens
PWLDRGRGLNRHEANGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLS

SEQ ID NO: 802567 - protein, 341 aa, Homo sapiens; identical to SEQ ID NO: 802556

SEQ ID NO: 802568 - protein, 168 aa, Homo sapiens
MVGPSSCSVPLNKPGGMEGPRAPPPYQAQALQGEPAETPEPVLDPGPLTLPTPSSVPGRGLGQSSWSSAGRPSSPSSGRHSPLSGRRPRGAEPGRVLGVHPSLRRQVPQGPTHLKPACTVEVVEVDTPRGFSKARLAAPCSGKLNYSRFRSSVDSHQSGGVLKEFYVD

SEQ ID NO: 802569 - protein, 168 aa, Homo sapiens; identical to SEQ ID NO: 802568

SEQ ID NO: 802570 - protein, 116 aa, Homo sapiens
MAGRSRPFPPLPGNRGSPQTDLRETSPRFRAPPAEPRARGLTRGPTQGPPERQDSGPDLQRLQAQRPQAAWAERRFQALARSLNCRKIFQHCFYKSLFRPNQRGDRGELKTPFFHV

SEQ ID NO: 802571 - protein, 168 aa, Homo sapiens; identical to SEQ ID NO: 802568

SEQ ID NO: 802572 - protein, 104 aa, Homo sapiens [sequence omitted]

SEQ ID NO: 802573 - protein, 105 aa, Homo sapiens
AGWYWSGVYGSPRAQPALVPAASRAPPPRAAEAGVAAALVPRTAARAGAGGDAAVTPPAGRVRAPWLAARALSHRCRETEARPKRICVKPAQGSGPPQPSPAPGD

SEQ ID NO: 802574 - protein, 340 aa, Homo sapiens
MNPFHASCWNTSAELLNKSWNKEFAYQTASVVDTVILPSMIGIICSTGLVGNILIVFTIIRSRKKTVPDIYICNLAVADLVHIVGMPFLIHQWARGGEWVFGGPLCTIITSLDTCNQFACSAIMTVMSVDRYFALVQPFRLTRWRTRYKTIRINLGLWAASFILALPVWVYSKVIKFKDGVESCAFDLTSPDDVLWYTLYLTITTFFFPLPLILVCYILILCYTWEMYQQNKDARCCNPSVPKQRVMKLTKMVLVLVVVFILSAAPYHVIQLVNLQMEQPTLAFYVGYYLSICLSYASSSINPFLYILLSGNFQKRLPQIQRRATEKEINNMGNTLKSHF

SEQ ID NO: 802575 - protein, 196 aa, Homo sapiens
MNPFHASCWNTSAELLNKSWNKEFAYQTASVVDTVILPSMIGIICSTGLVGNILIVFTIIRSRKKTVPDIYICNLAVADLVHIVGMPFLIHQWARGGEWVFGGPLCTIITSLDTCNQFACSAIMTVMSVDRYFALVQPFRLTRWRTRYKTIRINLGLWAASFILALPVWVYSKVIKFKDGVESCAFDLTSPDDVLW

SEQ ID NO: 802576 - protein, 186 aa, Homo sapiens
MYEAGVNRPCGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFRMTILPPLEKLRLLLEKLSRFHAKFTLEYS

SEQ ID NO: 802577 - protein, 496 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVYQDNVYAAGSQFHSFKKVLMEMGPPYAGQQELASFHSTSKGYMGECGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFRMTILPPLEKLRLLLEKLSRFHAKFTLEYS

SEQ ID NO: 802578 - protein, 489 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVRGAGEREAGQQSAPVTPCAFQVYQDNVYAAGSQFHSFKKVLMEMGPPYAGQQELASFHSTSKGYMGECGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFR

SEQ ID NO: 802579 - protein, 496 aa, Homo sapiens; identical to SEQ ID NO: 802577

SEQ ID NO: 802580 - protein, 496 aa, Homo sapiens; identical to SEQ ID NO: 802577

SEQ ID NO: 802581 - protein, 410 aa, Homo sapiens
SPVLPILSCPSPGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVRGAGEREAGQQSAPVTPCAFQVYQDNVYAAGSQFHSFKKVLMEMGPPYAGQQELASFHSTSKGYMGECGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFRMTILPPLEKLRLLLEKLSRFHAKFTLEYS

SEQ ID NO: 802582 - protein, 147 aa, Homo sapiens
SLSDGSPSTGAGPGPRYVLLPAPPGGDRHLRGARERLWAAGRHLPLPVRPGPHSLSRHPGPSLTVNSFQDDHSAPLGETAAAAGEAEQVPCQVHPRVLLSTPAGARLGRPGLCAQEPWEALEPTVLALDAWRGGVGGVLGPCLSAGP

SEQ ID NO: 802583 - protein, 53 aa, Homo sapiens
MKRQFGRLHSLFWKSWQKMNSFLLTPKLDTSLMSGWRYRQRLPRLHTFLKKSL

SEQ ID NO: 802584 - protein, 343 aa, Homo sapiens
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHIPGEYVRFTGYPCSWTFYHHLRQEILQEFTLHDHVREEAQKFLRGLQVNGSRPGTFVGVHVRRGDYVHVMPKVWKGVVADRRYLQQALDWFRARYSSLIFVVTSNGMAWCRENIDTSHGDVVFAGDGIEGSPAKDFALLTQCNHTIMTIGTFGIWAAYLTGGDTIYLANYTLPDSPFLKIFKPEAAFLPEWTGIAADLSPLLKH

SEQ ID NO: 802585 - protein, 343 aa, Homo sapiens; identical to SEQ ID NO: 802584

SEQ ID NO: 802586 - protein, 343 aa, Homo sapiens; identical to SEQ ID NO: 802584

SEQ ID NO: 802587 - protein, 373 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 802588 - protein, 194 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARFLYPFSPSFYPFLPLYLQGRYFDIF

SEQ ID NO: 802589 - protein, 358 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 802590 - protein, 373 aa, Homo sapiens; identical to SEQ ID NO: 802587

SEQ ID NO: 802591 - protein, 441 aa, Homo sapiens
MEIRLDTLSASLGRSSTLNNCNLEDKLAWYEGEAYMWHHWKPFPENPLWTCLDFQIAQVGPWDHCSSCIRHTRLKSSCSDMDLLHSWRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 802592 - protein, 357 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 802593 - protein, 106 aa, Homo sapiens
MRRACMGGVRVRLPDRCPRWDFEVRPACVPRGALFPEGFPGREQNRAASGAAWLCVFLCDCWMFPCVFLCVRVSVCVVCGERNVARAVKRGFSVVRLRSDAPVSLA

SEQ ID NO: 802594 - protein, 751 aa, Homo sapiens
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKGFLDACEKGPLSGHKLSGLRFVLQDGAHHMVDSNEISFIRAGEGALKQALANATLCILEPIMAVEVVAPNEFQGQVIAGINRRHGVITGQDGVEDYFTLYADVPLNDMFGYSTELRSCTEGKGEYTMEYSRYQPCLPSTQEDVINKYLEATGQLPVKKGKAKN

SEQ ID NO: 802595 - protein, 730 aa, Homo sapiens
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDKSENRILVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKGFLDACEKGPLSGHKLSGLRFVLQDGAHHMVDSNEISFIRAGEGALKQALANATLCILEPIMAVEVVAPNEFQGQVIAGINRRHGVITGQDGVEDYFTLYADVPLNDMFGYSTELRSCTEGKGEYTMEYSRYQPCLPSTQEDVINKYLEATGQLPVKKGKAKN

SEQ ID NO: 802596 - protein, 751 aa, Homo sapiens; identical to SEQ ID NO: 802594

SEQ ID NO: 802597 - protein, 410 aa, Homo sapiens
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEFLSRSFFRLTRQKDHRRPIQRTTLYLIVMSPYDLLGCNSFLDFPCFSRD

SEQ ID NO: 802598 - protein, 751 aa, Homo sapiens; identical to SEQ ID NO: 802594

SEQ ID NO: 802599 - protein, 702 aa, Homo sapiens
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKGFLDACEKGPLSGHKLSGLRFVLQDGAHHMVDSNEISFIRAGEGALKQALANATLCILEPIMAVEVVAPNEFQGQVIAGINRRHGVITGQDGVEDYFTLYADVSSLGHWQSCFY

SEQ ID NO: 802600 - protein, 591 aa, Homo sapiens
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKVNF

SEQ ID NO: 802601 - protein, 751 aa, Homo sapiens; identical to SEQ ID NO: 802594

SEQ ID NO: 802602 - protein, 751 aa, Homo sapiens; identical to SEQ ID NO: 802594

SEQ ID NO: 802603 - protein, 230 aa, Homo sapiens [sequence omitted]

SEQ ID NO: 802604 - protein, 229 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDADINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 802605 - protein, 145 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDGGAIPAPGC

SEQ ID NO: 802606 - protein, 145 aa, Homo sapiens; identical to SEQ ID NO: 802605

SEQ ID NO: 802607 - protein, 145 aa, Homo sapiens; identical to SEQ ID NO: 802605

SEQ ID NO: 802608 - protein, 145 aa, Homo sapiens; identical to SEQ ID NO: 802605

SEQ ID NO: 802609 - protein, 117 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMLTASCICCISVGSPQTLF

SEQ ID NO: 802610 - protein, 235 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDADINVTQKSFNFAKKFSLPLYFVSAADGTNVVKVWLTAELFNDAIRLAVSYKQNSQDFMDEIFQELENFSLEQEEEDVPDQEQSSSIETPSEEAASPHS

SEQ ID NO: 802611 - protein, 229 aa, Homo sapiens; identical to SEQ ID NO: 802604

SEQ ID NO: 802612 - protein, 229 aa, Homo sapiens; identical to SEQ ID NO: 802604

SEQ ID NO: 802613 - protein, 235 aa, Homo sapiens; identical to SEQ ID NO: 802610

SEQ ID NO: 802614 - protein, 90 aa, Homo sapiens
LDQGKYDADDNVKIICLGDSAVGKSKYVGRLGNKYQPQRGSRSFKKSSRGRGAWLLGAGEGAVLAGAQMFMGERGESREPLCVSGGGGRS

SEQ ID NO: 802615 - protein, 137 aa, Homo sapiens
SSCEDAGRAGSGVCCGASWAGGRGSRARRVQTGGRARGADPQRPWSLQPSLGTAREGKSAPVAGLARGDSPSEASLAVWARGRPGRGKHGKVASRGCCGGRDGQPGDAWTWLVAKNIYRKIAYPLRWQGHGQASLRP

SEQ ID NO: 802616 - protein, 145 aa, Homo sapiens; identical to SEQ ID NO: 802605

SEQ ID NO: 802617 - protein, 145 aa, Homo sapiens; identical to SEQ ID NO: 802605

SEQ ID NO: 802618 - protein, 145 aa, Homo sapiens; identical to SEQ ID NO: 802605

SEQ ID NO: 802619 - protein, 229 aa, Homo sapiens; identical to SEQ ID NO: 802604

SEQ ID NO: 802620 - protein, 229 aa, Homo sapiens; identical to SEQ ID NO: 802604

SEQ ID NO: 802621 - protein, 145 aa, Homo sapiens; identical to SEQ ID NO: 802605

SEQ ID NO: 802622 - protein, 127 aa, Homo sapiens
MMKLCKPKNMGKEETQEATLSPQGPLPARPPATVWDVSAVAPGGPAAGQPRAAWPRRLTAAVKGFWATRPSFSTFYFVFAIFVVSTIFHCHQHLALVPAPWAYSARVVLAPRHLPREDLFTINSKGR

SEQ ID NO: 802623 - protein, 86 aa, Homo sapiens
AGGSRPRLSLHTSPQAEGAGSGLGQPRDRLPQCSGGLKGSSSTARVDTEAEEDAKSDETSFWFKSFFRFHYGLFFYRCADVHSATF

SEQ ID NO: 802624 - protein, 52 aa, Homo sapiens
MCFSIEFSLVLKMSEKGHLGLAPAGSSGRAGGWGAATAGGTAGGAAGASPAP

SEQ ID NO: 802625 - protein, 225 aa, Homo sapiens
MASQARAVIPVLSQGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 802626 - protein, 220 aa, Homo sapiens
MPSSHDGLSGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 802627 - protein, 103 aa, Homo sapiens
MDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 802628 - protein, 103 aa, Homo sapiens; identical to SEQ ID NO: 802627

SEQ ID NO: 802629 - protein, 262 aa, Homo sapiens
MPRSPLRSSLSTEASGPRGPFKCPASPRPITAQLLPGSSPIIGRCVLRVQRGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 802630 - protein, 262 aa, Homo sapiens
MAPPPAPLLAPRPGETRPGCRKPGTVSFADVAVYFSPEEWGCLRPAQRALYRDVMQETYGHLGALGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSRILRRGKDWEELGEEMSPDIFEECG

SEQ ID NO: 802631 - protein, 276 aa, Homo sapiens
MAPPPAPLLAPRPGETRPGCRKPGTVSFADVAVYFSPEEWGCLRPAQRALYRDVMQETYGHLGALGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 802632 - protein, 199 aa, Homo sapiens
MEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 802633 - protein, 199 aa, Homo sapiens; identical to SEQ ID NO: 802632

SEQ ID NO: 802634 - protein, 103 aa, Homo sapiens; identical to SEQ ID NO: 802627

SEQ ID NO: 802635 - protein, 276 aa, Homo sapiens; identical to SEQ ID NO: 802631

SEQ ID NO: 802636 - protein, 545 aa, Homo sapiens
EILCPLSGRLFGCCRHLMATRVEEAARGRGGGAEEATEAGRGGRRRSPRQKFEIGTMEEAGICGLGVKADMLCNSQSNDILQHQGSNCGGTSNKHSLEEDEGSDFITENRNLVSPAYCTQESREEIPGGEARTDPPDGQQDSECNRNKEKTLGKEVLLLMQALNTLSTPEEKLAALCKKYADLLEESRSVQKQMKILQKKQAQIVKEKVHLQSEHSKAILARSKLESLCRELQRHNKTLKEENMQQAREEEERRKEATAHFQITLNEIQAQLEQHDIHNAKLRQENIELGEKLKKLIEQYALREEHIDKVFKHKELQQQLVDAKLQQTTQLIKEADEKHQREREFLLKEATESRHKYEQMKQQEVQLKQQLSLYMDKFEEFQTTMAKSNELFTTFRQEMEKMTKKIKKLEKETIIWRTKWENNNKALLQMAEEKTVRDKEYKALQIKLERLEKLCRALQTERNELNEKVEVLKEQVSIKAAIKAANRDLATPVMQPCTALDSHKELNTSSKRALGAHLEAEPKSQRSAVQKPPSTGSAPAIESVD

SEQ ID NO: 802637 - protein, 545 aa, Homo sapiens; identical to SEQ ID NO: 802636

SEQ ID NO: 802638 - protein, 86 aa, Homo sapiens
PGGAALLGPGKAGRQGRGQESPTLGVLRARAAVPLCALSPPPRKTSCTCEGHFRSFLSVRLECNGAIMAHCALHLPGSSHPPISAS

SEQ ID NO: 802639 - protein, 114 aa, Homo sapiens
HLPPPNGYSGSEMREIAEILPAQEKVEARIDLKMGKKPVTDHKLNVDKVIKNINTISSELKKIKELSQLLLCDLILHFNHPIKTENLAEAERNNPLFEESKISDVSLVSNSFSI

SEQ ID NO: 802640 - protein, 81 aa, Homo sapiens
EELGRWRQSHCGSLSLARAGSGGGSWGAGMWLSPPVNHGWGGVAEAPGWGLQRAICCSTQEALRLVGDRVSLCHPGWSEVA

SEQ ID NO: 802641 - protein, 81 aa, Homo sapiens; identical to SEQ ID NO: 802640

SEQ ID NO: 802642 - protein, 81 aa, Homo sapiens; identical to SEQ ID NO: 802640

SEQ ID NO: 802643 - protein, 81 aa, Homo sapiens; identical to SEQ ID NO: 802640

SEQ ID NO: 802644 - protein, 81 aa, Homo sapiens; identical to SEQ ID NO: 802640

SEQ ID NO: 802645 - protein, 552 aa, Homo sapiens
VRRAPPHEHLFPSGERGPFSFLVSRRGLGPGKMGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 802646 - protein, 287 aa, Homo sapiens
LLPEKCALMWLHLGTRAPQRPKRESRGFPGWGCRTGQALPCRARPPAPAPSHPSSSLSLTPGPGSPRQTGPPCQTVAALYGLGAWQSHCGGGVGCHGQGRQPLGCQGWWSTLNPYLLESPGLFHTRSCGKLWDPKAVLISGVTSSHSSLRSPGTRPGVSLCKELPGCWAELCCRPRKMTKKDRAEPHLPLLGGPEGARAQQSPILHSLGSKRLPRCGWQLLTSSGGAAGGLCPMGHRREKDGGRVCTLGRTGGRHRPEQVAWAHEKGVSETGCLSQMPGVDEADEWQ

SEQ ID NO: 802647 - protein, 259 aa, Homo sapiens
MVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKKLRSGWRRRTRKRTVRRLRAPRVGSTTKTAERRAVRRTEKSPCQGRLASAVPTSAQDPAVLSEALGASVRPDAQERAEGGWPRPGCELSPMV

SEQ ID NO: 802648 - protein, 552 aa, Homo sapiens; identical to SEQ ID NO: 802645

SEQ ID NO: 802649 - protein, 521 aa, Homo sapiens
VRRAPPHEHLFPSGERGPFSFLVSRRGLGPGKMGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 802650 - protein, 339 aa, Homo sapiens
MVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 802651 - protein, 552 aa, Homo sapiens; identical to SEQ ID NO: 802645

SEQ ID NO: 802652 - protein, 552 aa, Homo sapiens; identical to SEQ ID NO: 802645

SEQ ID NO: 802653 - protein, 552 aa, Homo sapiens; identical to SEQ ID NO: 802645

SEQ ID NO: 802654 - protein, 521 aa, Homo sapiens; identical to SEQ ID NO: 802649

SEQ ID NO: 802655 - protein, 107 aa, Homo sapiens
FLKQTETFNYMNAHMLKTACALPEGRACLSGYFCVLHSLTGCDKPCAHAASTAGRLRAGGDMPWSPLRRLRAGGDMPWPPVVSQRDRTPRALTRGRHGTHSRFLHAR

SEQ ID NO: 802656 - protein, 520 aa, Homo sapiens
MGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 802657 - protein, 463 aa, Homo sapiens
MGKKGKKEKKGRGAEKTAAKMEKKVSKRSRKEETFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 802658 - protein, 463 aa, Homo sapiens; identical to SEQ ID NO: 802657

SEQ ID NO: 802659 - protein, 552 aa, Homo sapiens; identical to SEQ ID NO: 802645

SEQ ID NO: 802660 - protein, 39 aa, Homo sapiens
MCVHSAFEETQEWLEETDSEEDSEEVEGAEGGVDDEDSG

SEQ ID NO: 802661 - protein, 1868 aa, Homo sapiens
QNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVPLKDDPGRGEGGASWSRRGRARSPGRGPRTEACAKARKGGRLWTEARTECDAGSAATRST

SEQ ID NO: 802662 - protein, 943 aa, Homo sapiens
QNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYTPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVPLKDDPGRGEGGASWSRRGRARSPGRGPRTEACAKARKGGRLWTEARTECDAGSAATRST

SEQ ID NO: 802663 - protein, 30 aa, Homo sapiens
MTSLPRKVTEACCTWKSSLSFENKGHVLKT

SEQ ID NO: 802664 - protein, 2004 aa, Homo sapiens
NVQDDKMEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDLVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 802665 - protein, 2004 aa, Homo sapiens; identical to SEQ ID NO: 802664

SEQ ID NO: 802666 - protein, 114 aa, Homo sapiens
MVKLGASAAEHQSHGSGLQPCKQPRAWEGSSPGHSASGASPQATVAQPGSPAFWAETTITLAVSSLRECRMLSQRPCTALIYRGKGSAGEVVAPGGAALECAASDSEFHALCIV

SEQ ID NO: 802667 - protein, 228 aa, Homo sapiens
QRAEDGKTELSLMRFSLAHPLWRPPGHSFKFLGHLWGRVQQDAAAWGATSARGPSTPGVLSNCTSPLPEAFLANLFVHPLLPPRDLSPTAPCPAAATASLLASISRIAQDPSSVSPGGTGGQKLAQLPELASAEMSLHVIYLHQLHQQQQQQEPWGEAAASILSRPCSSPSQPPSPDEEKPSWSSDGSSPASSPRQQWGTQKARNLFPGGFQVTTDTQKEPDRASCTD

SEQ ID NO: 802668 - protein, 228 aa, Homo sapiens; identical to SEQ ID NO: 802667

SEQ ID NO: 802669 - protein, 114 aa, Homo sapiens; identical to SEQ ID NO: 802666

SEQ ID NO: 802670 - protein, 626 aa, Homo sapiens
RLGTRLGVNSADLSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 802671 - protein, 425 aa, Homo sapiens
GTIAGRGWCNRTRRLSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 802672 - protein, 628 aa, Homo sapiens
GTIAGRGWCNRTRRLSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 802673 - protein, 647 aa, Homo sapiens
GTIAGRGWCNRTRRLSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRASSTQPAAAITHPPRCQERFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 802674 - protein, 82 aa, Homo sapiens
ARIRVFVRNTSEVVPGIRRRGMCQLFSFFLRKTMPLLVVRIFLGYLRGLALCFILSPDFFPVHLSLAISVYLISETSTRLIL

SEQ ID NO: 802675 - protein, 202 aa, Homo sapiens
WCHCAAARGRYHGGSDMGGRGADAGSSGGTGPTEGYSPPAASTRAAARAKARGGGRGGRRNTTPSVPSLRGAAPRSFHPPAAMSERLRPRKRRRNGNEEDNHLPPQTKRSSRNPVFQDSWDTESSGSDSGGSSSSSSSSINSPDRASGPEGSLSQTMAGSSPNTPQPVPEQSALCQGLYFHINQTLREAHFHSLQHRGRPLT

SEQ ID NO: 802676 - protein, 223 aa, Homo sapiens
WCHCAAARGRYHGGSDMGGRGADAGSSGGTGPTEGYSPPAASTRAAARAKARGGGRGGRRNTTPSVPSLRGAAPRSFHPPAAMSERLRPRKRRRNGNEEDNHLPPQTKRSSRNPVFQDSWDTETVPVMRNSKENRLRGNKAFCASSGSDSGGSSSSSSSSINSPDRASGPEGSLSQTMAGSSPNTPQPVPEQSALCQGLYFHINQTLREAHFHSLQHRGRPLT

SEQ ID NO: 802677 - protein, 223 aa, Homo sapiens; identical to SEQ ID NO: 802676

SEQ ID NO: 802678 - protein, 98 aa, Homo sapiens
CARQPRLPTPSARVVLYLHSSGSDSGGSSSSSSSSINSPDRASGPEGSLSQTMAGSSPNTPQPVPEQSALCQGLYFHINQTLREAHFHSLQHRGRPLT

SEQ ID NO: 802679 - protein, 155 aa, Homo sapiens
GQIGKGSHSYIKCCHMEGSTIRKRRRNGNEEDNHLPPQTKRSSRNPVFQDSWDTETVPVMRNSKENRLRGNKAFCASSGSDSGGSSSSSSSSINSPDRASGPEGSLSQTMAGSSPNTPQPVPEQSALCQGLYFHINQTLREAHFHSLQHRGRPLT

SEQ ID NO: 802680 - protein, 174 aa, Homo sapiens
KSGGPGTREREREKREERQSAWGRKERGREGWVRRRERSAANPRRRAWSPSQNSSPSRSRSQGGGCRDRQPCMMHLRLFCILLAAVSGAEGWGLLRLRRGAGGSPVCTLPGRLLLLQSPYCAAIRQAARHKRVVTTDWGSESLAPDRLNEEAPDPGRGHTGLLNSWDWVTRYML

SEQ ID NO: 802681 - protein, 223 aa, Homo sapiens
MTEEVDFLGQDSDGGSEEVVLTPAELIERLEQAWMNEKFAPELLESKPEIVECVMEQLEHMEENLRRAKREDLKVSIHQMEMERIRYVLSSYLRCRLMKIEKFFPHVLEKEKTRPEGEPSSLSPEELAFAREFMANTESYLKNVALKHMPPNLQKVDLFRAVPKPDLDSYVFLRVRERQENILVEPDTDEQRDYVIDLEKGSQHLIRYKTIAPLVASGAVQLI

SEQ ID NO: 802682 - protein, 143 aa, Homo sapiens
GCGLLLGPPCKLHLLICAGSDSSFHPTAWGAAAATLGTGRRHTATGTFVRDFAGKHMALGSQRSSLKILLLACTLVEPVASIFRVESRGILVLENVRPKGSNTREKCCQTHNGHDGIENLHSLKPKEGVKWQWISALLGCALV

SEQ ID NO: 802683 - protein, 466 aa, Homo sapiens
FCGRKMAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802684 - protein, 564 aa, Homo sapiens
QAGTPVLWDIVDHGARGKMAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802685 - protein, 461 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802686 - protein, 461 aa, Homo sapiens; identical to SEQ ID NO: 802685

SEQ ID NO: 802687 - protein, 390 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITIK

SEQ ID NO: 802688 - protein, 446 aa, Homo sapiens
MSKAPVYAILIALAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802689 - protein, 390 aa, Homo sapiens; identical to SEQ ID NO: 802687

SEQ ID NO: 802690 - protein, 499 aa, Homo sapiens
FDEGAWLLAAPRALAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802691 - protein, 336 aa, Homo sapiens
MAEVGEIIEGCRLPVLRRNQDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802692 - protein, 332 aa, Homo sapiens
HSGPLPGLSSPLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802693 - protein, 508 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKVGRQAGETGVWDAECSPLWADHLLNPSPLPRASTSSHCQRTSWMAMSGPCSSGSCGSTPSVCTSLPRTGARGGSGDQTLPTAVPRRQQDWG

SEQ ID NO: 802694 - protein, 292 aa, Homo sapiens
IRHYGKMAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSMTVRASTSWATSPRRKNQRKTTMWPAS

SEQ ID NO: 802695 - protein, 173 aa, Homo sapiens
MTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802696 - protein, 144 aa, Homo sapiens [sequence omitted]

SEQ ID NO: 802697 - protein, 144 aa, Homo sapiens [sequence omitted]

SEQ ID NO: 802698 - protein, 328 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTALMEYRQHHAMTGSLVSDRSHDDIVTRMKNIECIELGR

SEQ ID NO: 802699 - protein, 281 aa, Homo sapiens [sequence omitted]

SEQ ID NO: 802700 - protein, 312 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPLVPSTKASSGLRPTPRSAGHRPRPPLKQGPEGARQLCTVRRDPDGGALYRGLVIVKISFVK

SEQ ID NO: 802701 - protein, 91 aa, Homo sapiens
AHVTDSVDRHWLCTLWGFHLGLGLRLVTLRFPPSHRGSLAPRSWVAVSLKGPPLQGLREARAHRALGPGSDVSQRGRKWQWREGRWRRWGR

SEQ ID NO: 802702 - protein, 513 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802703 - protein, 552 aa, Homo sapiens
MAEVGKMAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802704 - protein, 461 aa, Homo sapiens; identical to SEQ ID NO: 802685

SEQ ID NO: 802705 - protein, 494 aa, Homo sapiens
MAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802706 - protein, 461 aa, Homo sapiens; identical to SEQ ID NO: 802685

SEQ ID NO: 802707 - protein, 461 aa, Homo sapiens; identical to SEQ ID NO: 802685

SEQ ID NO: 802708 - protein, 508 aa, Homo sapiens; identical to SEQ ID NO: 802693

SEQ ID NO: 802709 - protein, 453 aa, Homo sapiens
LVSPGLRTRAEPGHEDELALAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 802710 - protein, 461 aa, Homo sapiens; identical to SEQ ID NO: 802685

SEQ ID NO: 802711 - protein, 144 aa, Homo sapiens [sequence omitted]

SEQ ID NO: 802712 - protein, 173 aa, Homo sapiens; identical to SEQ ID NO: 802695

SEQ ID NO: 802713 - protein, 91 aa, Homo sapiens; identical to SEQ ID NO: 802701

SEQ ID NO: 802714 - protein, 347 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSEYVCCGQGVV

SEQ ID NO: 802715 - protein, 366 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGPSLLGMRRRTRVSQNWFGQVPDLALLRTNIPLREKKRAPGFREQRTRGPAHRQRYTEAHPNHLGKPTTG

SEQ ID NO: 802716 - protein, 405 aa, Homo sapiens
MAEVGKMAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGPSLLGMRRRTRVSQNWFGQVPDLALLRTNIPLREKKRAPGFREQRTRGPAHRQRYTEAHPNHLGKPTTG

SEQ ID NO: 802717 - protein, 420 aa, Homo sapiens
MSGSGRKDFDVKHILRLRWKLFSHPSPSTGGPAGGGCLQQDGSGSFEHWGPSQSRLLKSQERSGVSTFWKKPSSSSSSSSSPSSSSSSFNPLNGTLLPVATRLQQGAPGQGTQQPARTLFYVESLEEEVVPGMDFPGPHEKGLVLQELKVEPDNSSQATGEGCGHRLSSTGHSMTPQSDLDSSSSEEFYQAVHHAEQTFRKMESYLKQQQLCDVILIVGNRKIPAHRLVLSSVSDYFAAMFTSDVCEAKQEEIKMEGIDPNALWDLVQFAYTGCLELKEDTIENLLAAACLLQLPQVVEVCCHFLMKLLHPSNCLGIRAFADAQGCIELMKVAHSYTMENIMEVIRNQEFLLLPAEELHKLLASDDVNVPDEETIFHALMMHSGSSHLQTQQTKQTRKKQNFKNAKNQVKKAKNQNSKKV

SEQ ID NO: 802718 - protein, 748 aa, Homo sapiens
MSGSGRKDFDVKHILRLRWKLFSHPSPSTGGPAGGGCLQQDGSGSFEHWGPSQSRLLKSQERSGVSTFWKKPSSSSSSSSSPSSSSSSFNPLNGTLLPVATRLQQGAPGQGTQQPARTLFYVESLEEEVVPGMDFPGPHEKGLVLQELKVEPDNSSQATGEGCGHRLSSTGHSMTPQSDLDSSSSEEFYQAVHHAEQTFRKMESYLKQQQLCDVILIVGNRKIPAHRLVLSSVSDYFAAMFTSDVCEAKQEEIKMEGIDPNALWDLVQFAYTGCLELKEDTIENLLAAACLLQLPQVVEVCCHFLMKLLHPSNCLGIRAFADAQGCIELMKVAHSYTMENIMEVIRNQEFLLLPAEELHKLLASDDVNVPDEETIFHALMMWVKYDMQSRCNDLSMLLAFIRLPLLPPQILADLENHALFKNDLECQKLILEAMKYHLLPERRTLMQSPRTKPRKSTVGTLYAVGGMDNNKGATTIEKYDLRTNLWIQAGMMNGRRLQFGVAVIDDKLFVIGGRDGLKTLNTVECYNPKTKTWTVLPPMSTHRHGLGVTVLEGPIYAVGGHDGWSYLNTVERWDPQSQQWTFVASMSIARSTVGVAALNGKLYSVGGRDGSSCLSSMEYYDPHTNKWNMCAPMCKRRGGVGVATCDGFLYAVGGHDAPASNHCSRLLDYVERYDPKTDTWTMVAPLSMPRDAVGVCLLGDRLYAVGGYDGQTYLNTMESYDPQTNEWTQMASLNIGRAGACVVVIKQP

SEQ ID NO: 802719 - protein, 450 aa, Homo sapiens
QRRRGGRSREAGKQWPCEREELPPPPAPRRPRPPGPRRRGPRTALEKTSPPLHPPLSHRAAPASSSCAAGSGGTRNGRPLPPPSAASSFSSSSSSSSFSASSSAPGRSGVSAAAGSGGDSRFFWAAALGHVVSGKVMSRRAPGSRLSSGGGGGGTKYPRSWNDWQPRTDSASADPDNLKYSSSRDRGGSSSYGLQPSNSAVVSRQRHDDTRVHADIQNDEKERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLE

SEQ ID NO: 802720 - protein, 444 aa, Homo sapiens
QRRRGGRSREAGKQWPCEREELPPPPAPRRPRPPGPRRRGPRTALEKTSPPLHPPLSHRAAPASSSCAAGSGGTRNGRPLPPPSAASSSSSFSASSSAPGRSGVSAAAGSGGDSRFFWAAALGHVVSGKVMSRRAPGSRLSSGGGGGGTKYPRSWNDWQPRTDSASADPDNLKYSSSRDRGGSSSYGLQPSNSAVVSRQRHDDTRVHADIQNDEKERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLE

SEQ ID NO: 802721 - protein, 352 aa, Homo sapiens
NSHGSVSRRLVMTGKPGTDSASADPDNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLE

SEQ ID NO: 802722 - protein, 488 aa, Homo sapiens
SGGAAGGAGRRGSSGRVSVRSCRHRLLLVVLVLRGPGDVGRARPWKRRRLPFIRLSLTAPLPPPRPALRAQAEPGTAVLFPRPPPPPPPPPSRLPPQPRAGAGCRRRPVRAAALGHVVSGKVMSRRAPGSRLSSGGGGGGTKYPRSWNDWQPRTDSASADPDNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLE

SEQ ID NO: 802723 - protein, 362 aa, Homo sapiens
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 802724 - protein, 376 aa, Homo sapiens
MEEAPRERAYRGPTSSSSQPSRVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 802725 - protein, 168 aa, Homo sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 802726 - protein, 159 aa, Homo sapiens
MPWGPCSLPNVNKARVCAAKKKQHKKPHHTKNKNTNTKHTKQGGGAEKIPRGGPHFASPTICAQEGPPREDALNNTHARRPRNTPREGGEHADAGETPGRERTPTRRRGGTPCGLQTTPQQRNKTPRGSNNKPRGERGASHAPHSSARQQRRSHVCEKC

SEQ ID NO: 802727 - protein, 31 aa, Homo sapiens
MGGSTSLRPMQDSASPSRGAVRSYRARQACA

SEQ ID NO: 802728 - protein, 168 aa, Homo sapiens; identical to SEQ ID NO: 802725

SEQ ID NO: 802729 - protein, 168 aa, Homo sapiens; identical to SEQ ID NO: 802725

SEQ ID NO: 802730 - protein, 73 aa, Homo sapiens
IQKHQPELGIDGEEEQGIQGGVGSCQPQGHSRWQRRHQPGSRHQARQVTLHVREGGHRSRPFDSRIAVSSSGC

SEQ ID NO: 802731 - protein, 125 aa, Homo sapiens
MPVTKLGRLVKDMKIKSLEEIYLFSLPIKESEIIDFFLGASLKDEVSKIMPVQKQTRAGQRTRFKAFVAIGDYNGHVGLGVKCSKEVATAIRGAIILAKLSIVPVRRGYWGNKIGKPHTVPCKVT

SEQ ID NO: 802732 - protein, 125 aa, Homo sapiens; identical to SEQ ID NO: 802731

SEQ ID NO: 802733 - protein, 74 aa, Homo sapiens
AHEVGTGGVSGCGAKVTGRGRSFPCPSSDPTRTGRLASSHLEYGRKYFPQAYAKRGSVLSPLEGGLTQIPFRCV

SEQ ID NO: 802734 - protein, 168 aa, Homo sapiens; identical to SEQ ID NO: 802725

SEQ ID NO: 802735 - protein, 159 aa, Homo sapiens; identical to SEQ ID NO: 802726

SEQ ID NO: 802736 - protein, 152 aa, Homo sapiens
RTQAKRVEGWLDKGRDTELRCSSLDSGFHQTFGTFQPQASTASQKLGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 802737 - protein, 119 aa, Homo sapiens
LTQKPTRRECKARGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 802738 - protein, 130 aa, Homo sapiens
MVCVCVCLTGHAGICSLDPTPGQSSWVPRILGRPGMLVFVLLAGTCALCRPGWSAVVRSRLTAAWNSWPQRILPLQPPKVLGLQALTIAPGPLILELRSHLLGARSPALAFPFRALGILSSRLRHGVPGI

SEQ ID NO: 802739 - protein, 168 aa, Homo sapiens; identical to SEQ ID NO: 802725

SEQ ID NO: 802740 - protein, 78 aa, Homo sapiens
VPTYSGTTYLLVGSELGQGKLRPLPVTFAPHPETPPVPTALGSHLEYGRKYFPQAYAKRGSVLSPLEGGLTQIPFRCV

SEQ ID NO: 802741 - protein, 136 aa, Homo sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKVSASPQRART

SEQ ID NO: 802742 - protein, 125 aa, Homo sapiens
GQHLYPVNQFFFSMPVAGDSTIYIQASIAVIFQDGSKSFVIIKNRTEKQGVLKRREGGYRGVGDNSYTQHGQSLALHHFQQLWGYLLEWQVRWETGPLPRKRETFTNRDIGTLWAIRSPGNEGVL

SEQ ID NO: 802743 - protein, 232 aa, Homo sapiens
PRAPRSLPRPHAIPHLRPRPTQPQLGQTAPSPLPICNLQGDDDVISADLQSLQGPYLPLELGLEQLFQELAGEEEELNASQLQALLSIALEPARAHTSTPREIGLRTCEQLLQCFGTQHGQSLALHHFQQLWGYLLEWQAIFNKFDEDTSGTMNSYELRLALNAAGFHLNNQLTQTLTSRYRDSRLRVDFERFVSCVAHLTCIFCHCSQHLDGGEGVICLTHRQWMEVATFS

SEQ ID NO: 802744 - protein, 209 aa, Homo sapiens
PRAPRSLPRPHAIPHLRPRPTQPQLGQTAPSPLPICNLQGDDDVISADLQSLQGPYLPLELGLEQLFQELAGEEEELNASQLQALLSIALEPARAHTSTPREIGLRTCEQLLQCFGAIFNKFDEDTSGTMNSYELRLALNAAGFHLNNQLTQTLTSRYRDSRLRVDFERFVSCVAHLTCIFCHCSQHLDGGEGVICLTHRQWMEVATFS

SEQ ID NO: 802745 - protein, 119 aa, Homo sapiens
LSCLGGPIGSPLQGMEGSPDFILPAQAIFNKFDEDTSGTMNSYELRLALNAAGFHLNNQLTQTLTSRYRDSRLRVDFERFVSCVAHLTCIFCHCSQHLDGGEGVICLTHRQWMEVATFS

SEQ ID NO: 802746 - protein, 97 aa, Homo sapiens
LSCLGGPIGSPLQGMEGSPDFILPAQAIFNKFDEDTSGTMNSYELRLALNAAGFHLNNQLTQTLTSRYRDSRLRVDFERFVSCVAHLTCIFCEYHPG

SEQ ID NO: 802747 - protein, 166 aa, Homo sapiens
PGLHGPYLDPTRFLTWDPVPHSPSWGKQPPPHFPSVICREIDDVISADLQSLQGPYLPLELGLEQLFQELAGEAIFNKFDEDTSGTMNSYELRLALNAAGFHLNNQLTQTLTSRYRDSRLRVDFERFVSCVAHLTCIFCHCSQHLDGGEGVICLTHRQWMEVATFS

SEQ ID NO: 802748 - protein, 108 aa, Homo sapiens [sequence omitted]

SEQ ID NO: 802749 - protein, 549 aa, Homo sapiens
RSLAAGPEIKRGPPPAGHSALGNRDPAPDWRGRCAARWGAQGTEPGSCSPLAATSAGGAASGSWHLASPLRGEIGGYPAPAPGGKGTRGWGRPLAAAELPATGPVLLAAPAPATLGCPQLRPRQPETLPLEVPRLPDRTVRRQVGRAPPGAPEPRESLPGRPVPPPPRRPVARMRYADPSANRDLLGSRTLLFIFICAFALVTLLQQILYGRNYIKRYFEFYEGPFEYNSTRCLELRHEILEVKVLSMVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 802750 - protein, 302 aa, Homo sapiens
MVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 802751 - protein, 549 aa, Homo sapiens; identical to SEQ ID NO: 802749

SEQ ID NO: 802752 - protein, 360 aa, Homo sapiens
MNYTESSPLRESTAIGFTPELESIIPVPSNKTTCENWREIHHLVFHVANICFAVGLVIPTTLHLHMIFLRGMLTLGCTLYIVWATLYRCALDIMIWNSVFLGVNILHLSYLLYKKRPVKIEKELSGMYRRLFEPLRVPPDLFRRLTGQFCMIQTLKKGQTYAAEDKTSVDDRLSILLKGKMKVSYRGHFLHNIYPCAFIDSPEFRSTQMHKGEKFQVTIIADDNCRFLCWSRERLTYFLESEPFLYEIFRYLIGKDITNKLYSLNDPTLNDKKAKKLEHQLSLCTQISMLEMRNSIASSSDSDDGLHQFLRGTSSMSSLHVSSPHQRASAKMKPIEEGAEDDDDVFEPASPNTLKVHQLP

SEQ ID NO: 802753 - protein, 360 aa, Homo sapiens; identical to SEQ ID NO: 802752

SEQ ID NO: 802754 - protein, 397 aa, Homo sapiens
TVSGRRSGQAAPASPGPRPHRVPAPALCGGKPLGIFKMNYTESSPLRESTAIGFTPELESIIPVPSNKTTCENWREIHHLVFHVANICFAVGLVIPTTLHLHMIFLRGMLTLGCTLYIVWATLYRCALDIMIWNSVFLGVNILHLSYLLYKKRPVKIEKELSGMYRRLFEPLRVPPDLFRRLTGQFCMIQTLKKGQTYAAEDKTSVDDRLSILLKGKMKVSYRGHFLHNIYPCAFIDSPEFRSTQMHKGEKFQVTIIADDNCRFLCWSRERLTYFLESEPFLYEIFRYLIGKDITNKLYSLNDPTLNDKKAKKLEHQLSLCTQISMLEMRNSIASSSDSDDGLHQFLRGTSSMSSLHVSSPHQRASAKMKPIEEGAEDDDDVFEPASPNTLKVHQLP

SEQ ID NO: 802755 - protein, 397 aa, Homo sapiens; identical to SEQ ID NO: 802754

SEQ ID NO: 802756 - protein, 303 aa, Homo sapiens
QDHEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVRGRRVAAGQAVGGKPTGPGLGQAPWWWRLARGEIGGWAR

SEQ ID NO: 802757 - protein, 368 aa, Homo sapiens
LKVQAFTMDRTPSLVLGSVRNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGALVIVLASALLLLVLVLLVALRARFWKQSRGKGLLHGPQDDLRDNVLNYDEQGGGEGGPGRLTTSASCVTRKAEPASGNRRHFREL

SEQ ID NO: 802758 - protein, 340 aa, Homo sapiens
QDHEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGALVIVLASALLLLVLVLLVALRARFWKQSRGKGLLHGPQDDLRDNVLNYR

SEQ ID NO: 802759 - protein, 235 aa, Homo sapiens
MWRGRAGALLRVWGFWPTGVPRRRPLSCDAASQAGSNYPRCWNCGGPWGPGREDRFFCPQCRALQAPDPTRDYFSLMDCNRSFRVDTAKLQHRYQQLQRLVHPDFFSQRSQTEKDFSEKHSTLVNDAYKTLLAPLSRGLYLLKLHGIEIPERTDYEMDRQFLIEIMEINEKLAEAESEAAMKEIESIVKAKQKEFTDNVSSAFEQDDFEEAKEILTKMRYFSNIEEKIKLKKIPL

SEQ ID NO: 802760 - protein, 150 aa, Homo sapiens
MWRGRAGALLRVWGFWPTGVPRRRPLSCDAASQAGSNYPRCWNCGGPWGPGREDRFFCPQCRALQAPDPTRDYFSLMDCNRSFRVDTAKLQHRYQQLQRLVHPDFFSQRSQTEKDFSEKHSTLVNDAYKTLLAPLSRGLYLLNRKNLLTM

SEQ ID NO: 802761 - protein, 235 aa, Homo sapiens; identical to SEQ ID NO: 802759

SEQ ID NO: 802762 - protein, 105 aa, Homo sapiens
MWRGRAGALLRVWGFWPTGVPRRRPLSCDAASQAGSNYPRCWNCGGPWGPGREDRFFCPQCRALQAPDPTRDYFSLMDCNRSFRVDTAKLQHRLKRTSQRSIRPW

SEQ ID NO: 802763 - protein, 126 aa, Homo sapiens
MWRGRAGALLRVWGFWPTGVPRRRPLSCDAASQAGSNYPRCWNCGGPWGPGREDRFFCPQCRALQAPDPTRDYFSLMDCNRSFRVDTAKLQHRYQQLQRLVHPDFFSQRSQPPKMPGLQARATTAG

SEQ ID NO: 802764 - protein, 534 aa, Homo sapiens [sequence omitted]

SEQ ID NO: 802765 - protein, 583 aa, Homo sapiens
MQAARVDYIAPWWVVWLHSVPHVGLRLQPVNSTFSPGDESYQESLLFLGLVAAVCLGLNLIFLVAYLVCACHCRRDDAVQTKQHHSCCITWTAVVAGLICCAAVGVGFYGNSETNDGAYQLMYSLDDANHTFSGIDALVSGTTQKMKVDLEQHLARLSEIFAARGDYLQTLKFIQQMAGSVVVQLSGLPVWREVTMELTKLSDQTGYVEYYRWLSYLLLFILDLVICLIACLGLAKRSKCLLASMLCCGALSLLLSWASLAADGAAAVATSDFCVAPDTFILNVTEGQISTEVTRYYLYCSQSGSSPFQQTLTTFQRALTTMQIQVAGLLQFAVPLFSTAEEDLLAIQLLLNSSESSLHQLTAMVDCRGLHKAKPVPFAPSSQGVLLLAILASASVPPSLVPHPATSSALFRASFFSAQHTDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 802766 - protein, 534 aa, Homo sapiens [sequence omitted]

SEQ ID NO: 802767 - protein, 501 aa, Homo sapiens
MQAARVDYIAPWWVVWLHSVPHVGLRLQPVNSTFSPGDESYQESLLFLGLVAAVCLGLNLIFLVAYLVCACHCRRDDAVQTKQHHSCCITWTAVVAGLICCAAVGVGFYGNSETNDGAYQLMYSLDDANHTFSGIDALVSGTTQKMKVDLEQHLARLSEIFAARGDYLQTLKFIQQMAGSVVVQLSGLPVWREVTMELTKLSDQTGYVEYYRWLSYLLLFILDLVICLIACLGLAKRSKCLLASMLCCGALSLLLSWASLAADGAAAVATSDFCVAPDTFILNVTEGQISTEVTRYYLYCSQSGSSPFQQTLTTFQRALTTMQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTSTCHQNMDSRVFSAPSEASTTEWGHRAAGTPCLTYINPCILYAINSLWYIRVTCREELCDVKVLLLKVSLLATRGLFLMHGN

SEQ ID NO: 802768 - protein, 534 aa, Homo sapiens [sequence omitted]

SEQ ID NO: 802769 - protein, 512 aa, Homo sapiens
SVVGQDRKSGSGCYLRWLLFLSLLFLGLVAAVCLGLNLIFLVAYLVCACHCRRDDAVQTKQHHSCCITWTAVVAGLICCAAVGVGFYGNSETNDGAYQLMYSLDDANHTFSGIDALVSGTTQKMKVDLEQHLARLSEIFAARGDYLQTLKFIQQMAGSVVVQLSGLPVWREVTMELTKLSDQTGYVEYYRWLSYLLLFILDLVICLIACLGLAKRSKCLLASMLCCGALSLLLSWASLAADGAAAVATSDFCVAPDTFILNVTEGQISTEVTRYYLYCSQSGSSPFQQTLTTFQRALTTMQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 802770 - protein, 213 aa, Homo sapiens
MYVYSWPPPKQGVWPPPPQLLTCTYLAAPLLLPPVQAHSFRSRPGSLHAGEWAAPREYHRFYGPAAPPEAAPPWWACPPAYATTLRRPCAAAGISGLSLQAPAAVAESWAPWPEGGSLQTELRWGRVERARGPPLQLPDFVRRELRRAYGTYPRADVRVTQRRGQFLLQATPRVLEPDHRVEWRVRRRPDSGDSSPAREAAERGRPRKSKGLS

SEQ ID NO: 802771 - protein, 244 aa, Homo sapiens
AAQSGSRRASAAAAGGMASTASEIIAFMVSISGWVLVSSTLPTDYWKVSTIDGTVITTATYWANLWKACVTDSTGVSNCKDFPSMLALDGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 802772 - protein, 226 aa, Homo sapiens
MSRAQIWALVSGVGGFGALVAATTSNEWKVTTRASSVITATWVYQGLWMNCAGNALGSFHCRPHFTIFKVAGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 802773 - protein, 218 aa, Homo sapiens
AAQSGSRRASAAAAGGMASTASEIIAFMVSISGWVLVSSTLPTDYWKVSTIDGTVITTATYWANLWKACVTDSTGVSNCKDFPSMLALDGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRSGPQLSLPSGQ

SEQ ID NO: 802774 - protein, 218 aa, Homo sapiens; identical to SEQ ID NO: 802773

SEQ ID NO: 802775 - protein, 244 aa, Homo sapiens; identical to SEQ ID NO: 802771

SEQ ID NO: 802776 - protein, 207 aa, Homo sapiens
MSRAQIWALVSGVGGFGALVAATTSNEWKVTTRASSVITATWVYQGLWMNCAGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 802777 - protein, 171 aa, Homo sapiens
AAQSGSRRASAAAAGGMASTASEIIAFMVSISGWVLVSSTLPTDYWKVSTIDGTVITTATYWANLWKACVTDSTGVSNCKDFPSMLALDGYIQACRGLMIAAVSLGFFGSIFALFGMKCTKVGGSDKAKAKIACLAGIVFILSGLCSMTGCSLYANKITTEFFDPLFVEQK

SEQ ID NO: 802778 - protein, 227 aa, Homo sapiens [sequence omitted]

SEQ ID NO: 802779 - protein, 227 aa, Homo sapiens [sequence omitted]

SEQ ID NO: 802780 - protein, 172 aa, Homo sapiens
MTSGGGVGVNGGSMRPGGFLGAGQRLSRAMSRCVLEPRPPGKRWMVSGVGRRRRGSRSLASVRPLCPGSRVPPNCCSVFLTGLAWTHRQQQQHHHHHHHHHHHHHHHHHHQWLSPHCASWEPGSASRLHGHYRREQSHLSGSCGKRPRVDLTQAPHDWRGSICKDGALQCLR

SEQ ID NO: 802781 - protein, 196 aa, Homo sapiens
MTSGGGVGVNGGSMRPGGFLGAGQRLSRAMSRCVLEPRPPGKRWMVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALKLGGSARGHNGVRSCISCLNSNELLPLLLDRATDLILDHIRERSQGPSLGP

SEQ ID NO: 802782 - protein, 133 aa, Homo sapiens
MTSGGGVGVNGGSMRPGGFLGAGQRLSRAMSRCVLEPRPPGKRWMVAGLGNPGLPGTRHSVGMAVLGQLARRLGVAESWTRDRHCAADLALAPLGDAQLVLLRPRRLMNANGRSVARAGNAKAAGGYRAPGAP

SEQ ID NO: 802783 - protein, 190 aa, Homo sapiens
MTSGGGVGVNGGSMRPGGFLGAGQRLSRAMSRCVLEPRPPGKRWMVAGLGNPGLPGTRHSVGMAVLGQLARRLGVAESWTRAELFGLTAEEVYLVHDELDKPLGRLALKLGGSARGHNGVRSCISCLNSNAMPRLRVGIGRPAHPEAVQAHVLGCFSPAEQELLPLLLDRATDLILDHIRERSQGPSLGP

SEQ ID NO: 802784 - protein, 343 aa, Homo sapiens
MTSGGGVGVNGGSMRPGGFLGAGQRLSRAMSRCVLEPRPPGKRWMVSGVGRRRRGSRSLASVRPLCPGSRVPPNCCSVFLTGEFSARRAPNFLKLRSCTRAPCLPSLLEFSGVGFLGPFFAPLPHCSVALRFRSSALGPTGRCEIGGGESCWASVSWCRPQVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALKLGGSARGHNGVRSCISCLNSNAMPRLRVGIGRPAHPEAVQAHVLGCFSPAEQELLPLLLDRATDLILDHIRERSQGPSLGP

SEQ ID NO: 802785 - protein, 312 aa, Homo sapiens
MTSGGGVGVNGGSMRPGGFLGAGQRLSRAMSRCVLEPRPPGKRWMVSGVGRRRRGSRSLASVRPLCPGSRVPPNCCSVFLTGEFSARRAPNFLKLRSCTRAPCLPSLLEFSGVGFLGPFFAPLPHCSVALRFRSSALGPTGRCEIGGGESCWASVSWCRPQVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALKLGGSARGHNGVRSCISCLNSNELLPLLLDRATDLILDHIRERSQGPSLGP

SEQ ID NO: 802786 - protein, 437 aa, Homo sapiens
TPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 802787 - protein, 240 aa, Homo sapiens
TPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKVSPEPPAISCILGNHAQDTSAFPA

SEQ ID NO: 802788 - protein, 437 aa, Homo sapiens; identical to SEQ ID NO: 802786

SEQ ID NO: 802789 - protein, 161 aa, Homo sapiens
LPSPIHDECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 802790 - protein, 437 aa, Homo sapiens; identical to SEQ ID NO: 802786

SEQ ID NO: 802791 - protein, 451 aa, Homo sapiens
MREIVHIQIGQCGNQIGAKFWEMIGEEHGIDLAGSDRGASALQLERISVYYNEAYGRKYVPRAVLVDLEPGTMDSIRSSKLGALFQPDSFVHGNSGAGNNWAKGHYTEGAELIENVLEVVRHESESCDCLQGFQIVHSLGGGTGSGMGTLLMNKIREEYPDRIMNSFSVMPSPKVSDTVVEPYNAVLSIHQLIENADACFCIDNEALYDICFRTLKLTTPTYGDLNHLVSLTMSGITTSLRFPGQLNADLRKLAVNMVPFPRLHFFMPGFAPLTAQGSQQYRALSVAELTQQMFDARNTMAACDLRRGRYLTVACIFRGKMSTKEVDQQLLSVQTRNSSCFVEWIPNNVKVAVCDIPPRGLSMAATFIGNNTAIQEIFNRVSEHFSAMFKRKAFVHWYTSEGMDINEFGEAENNIHDLVSEYQQFQDAKAVLEEDEEVTEEAEMEPEDKGH

SEQ ID NO: 802792 - protein, 139 aa, Homo sapiens
SLSTRQFCPWYVFPEGSTRRRGGCFTGALLFSPFFPCWFLFLATGNSGAGNNWAKGHYTEGAELIENVLEVVRHESESCDCLQGFQIVHSLGGGTGSGMGTLLMNKIREEYPDRIMNSFSVMPSPKVSDTVVEPYNAVL

SEQ ID NO: 802793 - protein, 375 aa, Homo sapiens
MANASEPGGSGGGEAAALGLKLATLSLLLCVSLAGNVLFALLIVRERSLHRAPYYLLLDLCLADGLRALACLPAVMLAARRAAAAAGAPPGALGCKLLAFLAALFCFHAAFLLLGVGVTRYLAIAHHRFYAERLAGWPCAAMLVCAAWALALAAAFPPVLDGGGDDEDAPCALEQRPDGAPGALGFLLLLAVVVGATHLVYLRLLFFIHDRRKMRPARLVPAVSHDWTFHGPGATGQAAANWTAGFGRGPTPPALVGIRPAGPGRGARRLLVLEEFKTEKRLCKMFYAVTLLFLLLWGPYVVASYLRVLVRPGAVPQAYLTASVWLTFAQAGINPVVCFLFNRELRDCFRAQFPCCQSPRTTQATHPCDLKGIGL

SEQ ID NO: 802794 - protein, 375 aa, Homo sapiens; identical to SEQ ID NO: 802793

SEQ ID NO: 802795 - protein, 257 aa, Homo sapiens
MRTAFTPKTGAVPALIRQNGIRRLGYTYSLSDPILNQTQYSDEYTWKSHSKEDLIKTETSRGIKSHKSHLNEDIFLWTLPHCQQTGTLKNCLPWKIPASMKEVNKALSNQFISLTKRDFVDRSKAQKIKKSSHLSLEWKKLLPQPPDTEFRRNYQIPAKIPELQDFSFKYGCYSSLPVASQGLVPSVLHSYLRNQEHTKKQTTYQSDYDKTYPDFLMLLNSFTSSQVKEYLQSLSYKDRQIIDRFIRTHCDTNKKKK

SEQ ID NO: 802796 - protein, 295 aa, Homo sapiens
AASWGRMEQPGPRAPDPSLCHHNLQPTDDPNWDSYATTMRTAFTPKTGAVPALIRQNGIRRLGYTYSLSDPILNQTQYSDEYTWKSHSKEDLIKTETSRGIKSHKSHLNEDIFLWTLPHCQQTGTLKNCLPWKIPASMKEVNKALSNQFISLTKRDFVDRSKAQKIKKSSHLSLEWKKLLPQPPDTEFRRNYQIPAKIPELQDFSFKYGCYSSLPVASQGLVPSVLHSYLRNQEHTKKQTTYQSDYDKTYPDFLMLLNSFTSSQVKEYLQSLSYKDRQIIDRFIRTHCDTNKKKK

SEQ ID NO: 802797 - protein, 1720 aa, Homo sapiens
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRFLEENADPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRYRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMMDKYPGIRQILEKKEGLFRKHMMGKRVDYAARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKADVKRQRIIEESTHCGPQAVRAALNLPEAASYDEVRGKWQDAHLGKDQRDFNMIDLKFKEEVNHYSNEINKACMPFGLHRQFPENTLQLMVQSGAKGSTVNTMQISCLLGQIELEGRRPPLMASGKSLPCFEPYEFTPRAGGFVTGRFLTGIKPPEFFFHCMAGREGLVDTAVKTSRSGYLQRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRSPGTQEMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVGLGTEEDPSLPALLTQPRKPTHSQEPQGPEAMERRVQAVREIHPFIDDYQYDTEESLWCQVTVKLPLMKINFDMSSLVVSLAHGAVIYATKGITRCLLNETTNNKNEKELVLNTEGINLPELFKYAEVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 802798 - protein, 1720 aa, Homo sapiens; identical to SEQ ID NO: 802797

SEQ ID NO: 802799 - protein, 846 aa, Homo sapiens
VSGELCIVGECRGRQSSQQLGLDGSPGLGVAAKLLSNSELQLLLLLENHQEMQPWLGDTGASPDPGALDLACSEVLLLPAEQEPPFPSPPLPPTLIRGCPGEVMGRRGLSRWCPYRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRSPGTQEMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVGLGTEEDPSLPALLTQPRKPTHSQEPQGPEAMERRVQAVREIHPFIDDYQYDTEESLWCQVTVKLPLMKINFDMSSLVVSLAHGAVIYATKGITRCLLNETTNNKNEKELVLNTEGINLPELFKYAEVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 802800 - protein, 938 aa, Homo sapiens
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRFLEENADPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRYRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMMDKYPGIRQILEKKEGLFRKHMMGKRVDYAARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKADVKRQRIIEESTHCGPQAVRAALNLPEAASYDEVRGKWQDAHLGKDQRDFNMIDLKFKEEVNHYSNEINKACMPFGLHRQFPENTLQLMVQSGAKGSTVNTMQISCLLGQIELEGRSTPADGVWQVTALL

SEQ ID NO: 802801 - protein, 147 aa, Homo sapiens
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRVGG

SEQ ID NO: 802802 - protein, 1720 aa, Homo sapiens; identical to SEQ ID NO: 802797

SEQ ID NO: 802803 - protein, 156 aa, Homo sapiens
ERERPGGDTQAEGSRRPGPLNKSLPSSLQVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 802804 - protein, 277 aa, Homo sapiens [sequence omitted]

SEQ ID NO: 802805 - protein, 296 aa, Homo sapiens
MRGITTITVNQSLLSPLNLEVDSNIQAVYTQEKEQIKTLNNKFASFTDQVWFLEQQNKVLETKWSLLQQHKMAGSNMDNMFGSYINNLRRLLEQEKLRLEAELGNMQGLVEDFRNKYEDEINKPTEMENEFVLIKKDVDETYMNNVELESHLEGPTVRSGDPGAAVPDLQHVCGAVHGQQPLLDMDSIITEVKRQYKEVANCSRAEAESTYQIKYVELQTLARKHRDDLRHTKTQISKMNRNISQLQAEIEGLQGQGASLEATIPDAEHRGELAVKDANAKLSKLEATLQRVSTRS

SEQ ID NO: 802806 - protein, 68 aa, Homo sapiens
GSGPGGVRRGQAGKDHVPSERGVGSNREVDLRGNQQGEGEARERSRASCFAPLVQEALDAGGSGSRLR

SEQ ID NO: 802807 - protein, 296 aa, Homo sapiens; identical to SEQ ID NO: 802805

SEQ ID NO: 802808 - protein, 66 aa, Homo sapiens
RPRVLPGGAAGAAEAAGGGGVVERRQYKRLGPSPRTCPSQNGGRERAEVTLKRLLYTGDITKKGLR

SEQ ID NO: 802809 - protein, 305 aa, Homo sapiens
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 802810 - protein, 305 aa, Homo sapiens; identical to SEQ ID NO: 802809

SEQ ID NO: 802811 - protein, 305 aa, Homo sapiens; identical to SEQ ID NO: 802809

SEQ ID NO: 802812 - protein, 238 aa, Homo sapiens [sequence omitted]

SEQ ID NO: 802813 - protein, 238 aa, Homo sapiens [sequence omitted]

SEQ ID NO: 802814 - protein, 386 aa, Homo sapiens
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLSWPTYYPNLKKQHVEKMAPCALERGSHPSLESPPIPSRTSLTLGGSGVRTIISVLHLFFCFLPSKSKTWARGLTEWGWVGVGKRETGGIWNMALSRTVELT

SEQ ID NO: 802815 - protein, 305 aa, Homo sapiens; identical to SEQ ID NO: 802809

SEQ ID NO: 802816 - protein, 305 aa, Homo sapiens; identical to SEQ ID NO: 802809

SEQ ID NO: 802817 - protein, 230 aa, Homo sapiens
GTRITKARNFWERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 802818 - protein, 113 aa, Homo sapiens
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRLEAHQYIAWR

SEQ ID NO: 802819 - protein, 190 aa, Homo sapiens
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMSQSCIFSSAFFLQIWEQENV

SEQ ID NO: 802820 - protein, 305 aa, Homo sapiens; identical to SEQ ID NO: 802809

SEQ ID NO: 802821 - protein, 347 aa, Homo sapiens
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQVKESPGSFSHLFPIPTPSGACPSWSHDHDLCPTFELLGSLFQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 802822 - protein, 350 aa, Homo sapiens
MGHALCVCSRGTVIIDNKRYLFIQKLGEGFLLEPHLGKVSAKWEGHPTPHQEISLGPSHVGDDHGPLLTPLAHSGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 802823 - protein, 169 aa, Homo sapiens
MRPGCCYHSSRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 802824 - protein, 321 aa, Homo sapiens
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQNLLIWIPTNSIRTFFTL

SEQ ID NO: 802825 - protein, 305 aa, Homo sapiens; identical to SEQ ID NO: 802809

SEQ ID NO: 802826 - protein, 282 aa, Homo sapiens
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRIFSQWGGVPESNEEPGTRIKGA

SEQ ID NO: 802827 - protein, 277 aa, Homo sapiens
QVQGRAARSLIFPKRRRSVAVAAVVGRPSAGHKPPPVGGSWCADRGGREARSEREAMQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTSGSLSIIKSKIPTYCSICC

SEQ ID NO: 802828 - protein, 221 aa, Homo sapiens
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTSGSLSIIKSKIPTYCSICC

SEQ ID NO: 802829 - protein, 269 aa, Homo sapiens
MWNPHIRRANCNLSLSLLQEQLFDVKEDRNLAIKFHPKLPLNWSEREAMQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTSGSLSIIKSKIPTYCSICC

SEQ ID NO: 802830 - protein, 243 aa, Homo sapiens
MWNPHIRRANCNLSLSLLQEQLFDVKEDRNLAIKFHPKLPLNWSEREAMQKSEGSGGTQLKNRATGNYDQRTSSSTQLKHRNAVQGSKSSLSTSSPESARKLHPRPSDKLNPKTINPGLRETKHPYTFVSKEGFRELLLVKGAPEKAIPLLPRLIPVLKAALVHSDDEVFERGLNALVQLSVVVGPSLNDHLKHLLTSLSKRLMDKKFKEPITSALQKLEQHGGSGSLSIIKSKIPTYCSICC

SEQ ID NO: 802831 - protein, 134 aa, Homo sapiens [sequence omitted]

SEQ ID NO: 802832 - protein, 123 aa, Homo sapiens
MQKSEGSGGTQLKNRATGNYDQRTSSSTQLKHRNAVQGSKSSLSTSSPESARKLHPRPSDKLNPKTINPVHSDDEVFERGLNALVQLSVVVGPSLNDHLKHLLTSGSLSIIKSKIPTYCSICC

SEQ ID NO: 802833 - protein, 277 aa, Homo sapiens; identical to SEQ ID NO: 802827

SEQ ID NO: 802834 - protein, 277 aa, Homo sapiens; identical to SEQ ID NO: 802827

SEQ ID NO: 802835 - protein, 123 aa, Homo sapiens; identical to SEQ ID NO: 802832

SEQ ID NO: 802836 - protein, 184 aa, Homo sapiens
MWNPHIRRANCNLSLSLLQEQLFDVKEDRNLAIKFHPKLPLNWSEREAMQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEVNMPSLEYLSENKH

SEQ ID NO: 802837 - protein, 304 aa, Homo sapiens
QVQGRAARSLIFPKRRRSVAVAAVVGRPSAGHKPPPVGGSWCADRGGREARSEREAMQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTSLSKRLMDKKFKEPITSALQKLEQHGGSGSLSIIKSKIPTYCSICC

SEQ ID NO: 802838 - protein, 221 aa, Homo sapiens; identical to SEQ ID NO: 802828

SEQ ID NO: 802839 - protein, 221 aa, Homo sapiens; identical to SEQ ID NO: 802828

SEQ ID NO: 802840 - protein, 277 aa, Homo sapiens; identical to SEQ ID NO: 802827

SEQ ID NO: 802841 - protein, 232 aa, Homo sapiens
WYWSRNPYDWRSVAVAAVVGRPSAGHKPPPVGGSWCADRGGREARLLQEQLFDVKEDRNLAIKFHPKLPLNWSEREAMQKSEGSGGTQLKNRATGNYDQRTSSSTQLKHRNAVQGSKSSLSTSSPESARKLHPRPSDKLNPKTINPGLRETKHPYTFVSKEGFRELLLVKGAPEKAIPLLPRLIPVLKAALVHSDDEVFERGLNALVQLSVVVGPSLNDHLKHLLTSVLVSA

SEQ ID NO: 802842 - protein, 304 aa, Homo sapiens; identical to SEQ ID NO: 802837

SEQ ID NO: 802843 - protein, 594 aa, Homo sapiens
LRCHSAWTRFFGSRVHSGPAPASAPMDAAFLLVLGLLAQSLCLSLGVPGWRRPTTLYPWRRAPALSRVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDLEIVVVDQNDNRPAFLQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEFTRDEFFMEAIEAVSGVDVGRLEVEDRDLPGSPNWVARFTILEGDPDGQFTIRTDPKTNEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEQTSQALWRQGETAPRAFIQWAGPIRGWVTGSGSAGRTSQVRYLAGRTPELRGGEVVRDWGRMDAWSRGGHKKERA

SEQ ID NO: 802844 - protein, 839 aa, Homo sapiens
LRCHSAWTRFFGSRVHSGPAPASAPMDAAFLLVLGLLAQSLCLSLGVPGWRRPTTLYPWRRAPALSRVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDLEIVVVDQNDNRPAFLQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEFTRDEFFMEAIEAVSGVDVGRLEVEDRDLPGSPNWVARFTILEGDPDGQFTIRTDPKTNEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGALVIVLASALLLLVLVLLVALRARFWKQSRGKGLLHGPQDDLRDNVLNYDEQGGGEEDQDAYDISQLRHPTALSLPLGPPPLRRDAPQGRLHPQPPRVLPTSPLDIADFINDGLEAADSDPSVPPYDTALIYDYEGDGSVAGTLSSILSSQGDEDQDYDYLRDWGPRFARLADMYGHPCGLEYGARWDHQAREGLSPGALLPRHRGRTA

SEQ ID NO: 802845 - protein, 359 aa, Homo sapiens
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGKRMHVQLSTSRLRTAPGMGDQSGCYRCGKEGHWSKECPVDRTGRVADFTEQYNEQYGAVRTPYTMGYGESMYYNDAYGALDYYKRYRVRSYEAVAAAAAASAYNYAEQTMSHLPQVQSTTVTSHLNSTSVDPYDRHLLPNSGAAATSAAMAAAAATTSSYYGRDRSPLRRAAAMLPTVGEGYGYGPESELSQASAATRNSLYDMARYEREQYVDRARYSAF

SEQ ID NO: 802846 - protein, 359 aa, Homo sapiens; identical to SEQ ID NO: 802845

SEQ ID NO: 802847 - protein, 359 aa, Homo sapiens; identical to SEQ ID NO: 802845

SEQ ID NO: 802848 - protein, 359 aa, Homo sapiens; identical to SEQ ID NO: 802845

SEQ ID NO: 802849 - protein, 219 aa, Homo sapiens [sequence omitted]

SEQ ID NO: 802850 - protein, 64 aa, Homo sapiens
HSIGALGGHLGCKKCGAWLPVSKSTPKVSTAAIKRGGPPSCRIRHELVSYVSEENEDCKQWLFN

SEQ ID NO: 802851 - protein, 151 aa, Homo sapiens
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGELLWAWVVAPSGV

SEQ ID NO: 802852 - protein, 151 aa, Homo sapiens
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEIRSLFEQYGKVLECDIIKNYGSGTPLILLSLGVESFSLPTCSISFPFKMTM

SEQ ID NO: 802853 - protein, 64 aa, Homo sapiens; identical to SEQ ID NO: 802850

SEQ ID NO: 802854 - protein, 359 aa, Homo sapiens; identical to SEQ ID NO: 802845

SEQ ID NO: 802855 - protein, 359 aa, Homo sapiens; identical to SEQ ID NO: 802845

SEQ ID NO: 802856 - protein, 359 aa, Homo sapiens; identical to SEQ ID NO: 802845

SEQ ID NO: 802857 - protein, 143 aa, Homo sapiens
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGRIIAD

SEQ ID NO: 802858 - protein, 64 aa, Homo sapiens; identical to SEQ ID NO: 802850

SEQ ID NO: 802859 - protein, 64 aa, Homo sapiens; identical to SEQ ID NO: 802850

SEQ ID NO: 802860 - protein, 64 aa, Homo sapiens; identical to SEQ ID NO: 802850

SEQ ID NO: 802861 - protein, 307 aa, Homo sapiens
PLPVPAPSIDRSTKPPLDRSLAPFDREPFTLGKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQSASLPPYFSQGPSNRPPIRAEGRNFPLPLPNKPRPPSPAEEENSLNEEWYVSYITRPEAEAALRKINQDGTFLVRDSSKKTTTNPYVLMVLYKDKVYNIQIRYQKESQVYLLGTGLRGKEDFLSVSDIIDYFRKMPLLLIDGKNRGSRYQCTLTHAAGYP

SEQ ID NO: 802862 - protein, 230 aa, Homo sapiens [sequence omitted]

SEQ ID NO: 802863 - protein, 292 aa, Homo sapiens
PLPVPAPSIDRSTKPPLDRSLAPFDREPFTLGKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQSASLPPYFSQGPSNRPPIRAEGRNFPLPLPNKPRPPSPAEEENSLNEEWYVSYITRPEAEAALRKINQDGTFLVRDSSKKTTTNPYVLMVLYKDKVYNIQIRYQKESQVYLLGTGLRGKEVRISNFDIFPKSLFMPLCMPSWSDL

SEQ ID NO: 802864 - protein, 71 aa, Homo sapiens
FPPPPPSNDAMIELYPGLLVRLPKKTKFMCNSADYLIVSQNVKLHAWFDGNISHIYVFYTHVGKESVTANE

SEQ ID NO: 802865 - protein, 237 aa, Homo sapiens
PLPVPAPSIDRSTKPPLDRSLAPFDREPFTLGKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQSASLPPYFSQGPSNRPPIRAEGRNFPLPLPNKPRPPSPAEEENSLNEEWYVSYITRPEAEAALRKINQDAILAERLKKHHLFSVCKYPLD

SEQ ID NO: 802866 - protein, 103 aa, Homo sapiens
TDRLNFPCTSSITTDIVRDSSKKTTTNPYVLMVLYKDKVYNIQIRYQKESQVYLLGTGLRGKEDFLSVSDIIDYFRKMPLLLIDGKNRGSRYQCTLTHAAGYP

SEQ ID NO: 802867 - protein, 190 aa, Homo sapiens
PLPVPAPSIDRSTKPPLDRSLAPFDREPFTLGKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQSASLPPYFSQGPSNRPPIRAEGRNFPLPLPNKPRPPSPAEEEG

SEQ ID NO: 802868 - protein, 100 aa, Homo sapiens
GGSEKQGLARPPGLGRLRARLPPRPGHRIVWGTGPAAGLIPLFLPASIEGEYVPVEGDEVTYKMCPIPPKNQKFQAVEVVLTQLAPHTPHETWSGQVVGS

SEQ ID NO: 802869 - protein, 153 aa, Homo sapiens
MTSESTSPPVVPPLHSPKSPVWPTFPFHREGSRVWERGGVPPRDLPSPLPTKRTRTYSATARASAGPVFKGVCKQFSRSQGHGFITPENGSEDIFVHVSDIEGEYVPVEGDEVTYKMCPIPPKNQKFQAVEVVLTQLAPHTPHETWSGQVVGS

SEQ ID NO: 802870 - protein, 104 aa, Homo sapiens
RYPQGRHISNVAILSNSAHTIEVCEQSLLAFTLSERWNGLSANAPYYKQFLTKKVPDSRAEFGTRRELVSSFFFFFFLFFFFFFFFNSGEVGKSVHAELPRLSR

SEQ ID NO: 802871 - protein, 427 aa, Homo sapiens
MQIDSLNHIQDKNEKDDSQKDTSKKVQTISDCEKQALAQSEPGQLADSKEETPKIEKEDGLTSQPGNEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 802872 - protein, 600 aa, Homo sapiens
MTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPGNEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLERTKLHESHKVTGAEQGLQVSGLPDSAAPEGGAAHTNDQRRCQRMKQPLTEVQILSHSS

SEQ ID NO: 802873 - protein, 344 aa, Homo sapiens
RQNRIRKRSNLPRQSHFSMTGLCGYSAPDMRGLRLIMIPVELLLCYLLLHPVDATSYGKQTNVLMHFPLSLESQTPSSDPLSCQFLHPKSLPGFSHMAPLPKFLVSLALRNALEEAGCQADVWALQLQLYRQGGVNATQVLIQHLRGLQKGRSTERNVSVEALASALQLLAREQQSTGRVGRSLPTEDCENEKEQAVHNVVQLLPGVGTFYNLGTALYYATQNCLGKARERGRDGAIDLGYDLLMTMAGMSGGPMGLAISAALKPALRSGVQQLIQYYQDQKDANISQPETTKEGLRAISDVSDLEETTTLASFISEVVSSAPYWGWAIIKSYDLDPGAGSLEI

SEQ ID NO: 802874 - protein, 315 aa, Homo sapiens [sequence omitted]

SEQ ID NO: 802875 - protein, 697 aa, Homo sapiens
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 802876 - protein, 199 aa, Homo sapiens
SRTCYPGIPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDTRREVPARS

SEQ ID NO: 802877 - protein, 494 aa, Homo sapiens [sequence omitted]

SEQ ID NO: 802878 - protein, 180 aa, Homo sapiens
ESVPSSTQPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 802879 - protein, 697 aa, Homo sapiens; identical to SEQ ID NO: 802875

SEQ ID NO: 802880 - protein, 697 aa, Homo sapiens; identical to SEQ ID NO: 802875

SEQ ID NO: 802881 - protein, 697 aa, Homo sapiens; identical to SEQ ID NO: 802875

SEQ ID NO: 802882 - protein, 579 aa, Homo sapiens [sequence omitted]

SEQ ID NO: 802883 - protein, 697 aa, Homo sapiens; identical to SEQ ID NO: 802875

SEQ ID NO: 802884 - protein, 669 aa, Homo sapiens
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 802885 - protein, 125 aa, Homo sapiens
MVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 802886 - protein, 697 aa, Homo sapiens; identical to SEQ ID NO: 802875

SEQ ID NO: 802887 - protein, 697 aa, Homo sapiens; identical to SEQ ID NO: 802875

SEQ ID NO: 802888 - protein, 697 aa, Homo sapiens; identical to SEQ ID NO: 802875

SEQ ID NO: 802889 - protein, 647 aa, Homo sapiens
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASMYVILVVVVKCFGKNSSLKYYLSLCI

SEQ ID NO: 802890 - protein, 70 aa, Homo sapiens
MKNKEWASDFQGIEQKRLLSIRCVPSAVLDKKTYTQWSQRETSEVGAPVRSSSRNQIYLPPETNDEQAKP

SEQ ID NO: 802891 - protein, 292 aa, Homo sapiens
SRAPSATDAPGPSGGALPCRPVDRRPWPVDSRVSLLHPASLDMNVRRVESISAQLEEASSTGGFLYAQNSTKRSIKERLMKLLPCSAAKTSSPAIQNSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 802892 - protein, 258 aa, Homo sapiens
SRAPSATDAPGPSGGALPCRPVDRRPWPVDSRVSLLHPASLDMNVRRVESISAQLEEASSTGDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 802893 - protein, 239 aa, Homo sapiens
MSMKVDYPWNFQIRAQPAILGFQPVRFSAENPVKCVQTSNLQNYSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 802894 - protein, 162 aa, Homo sapiens
MSGCRKRCKREILKFAQYLLRLLTGSLHTDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEVRDASPTS

SEQ ID NO: 802895 - protein, 292 aa, Homo sapiens; identical to SEQ ID NO: 802891

SEQ ID NO: 802896 - protein, 188 aa, Homo sapiens
MATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 802897 - protein, 157 aa, Homo sapiens
SRAPSATDAPGPSGGALPCRPVDRRPWPVDSRVSLLHPASLDMNVRRVESISAQLEEASSTGGFLYAQNSTKRSIKERLMKLLPCSAAKTSSPAIQNSVEDELEMATVRHRPEALELLEAQSKFTKKELQILYRGFKNVRTFFLTLPSHNSQRSIEK

SEQ ID NO: 802898 - protein, 116 aa, Homo sapiens
IRLERHTKTHARSVLKNAVAGDPQIMLPEHPQMNQACNQRENVAYPVFTSDTHIHPQAMRTFSLTFSAWIRGSFLISLPRGAVSYSSRNRQSDTRTRGNGGGCVWGLTRHLGLKTR

SEQ ID NO: 802899 - protein, 228 aa, Homo sapiens
MPRRGLVAGPDLEYFQRRYFTPAEVAQHNRPEDLWVSYLGRVYDLTSLAQEYKGNLLLKPIVEVAGQDISHWFDPKTRDIRKHIDPLTGCLRYCTPRGRFVHVPPQLPCSDWANDFGKPWWQGSYYEVGRLSAKTRSIRIINTLTSQEHTLEVGVLESIWEILHRYLPYNSHAASYTWKYEGKNLNMDFTLEENGIRDEEEEFDYLSMDGTLHTPAILLYFNDDLTEL

SEQ ID NO: 802900 - protein, 228 aa, Homo sapiens; identical to SEQ ID NO: 802899

SEQ ID NO: 802901 - protein, 228 aa, Homo sapiens; identical to SEQ ID NO: 802899

SEQ ID NO: 802902 - protein, 228 aa, Homo sapiens; identical to SEQ ID NO: 802899

SEQ ID NO: 802903 - protein, 93 aa, Homo sapiens
PLVGRSSSRDEHAGSGRSQLFSAGLSNQSFYCKAPYAAQSVMGAVVPPRPRRVPGSEWRSGKGACAKSRFWLRRNRRWAFSTTFGKIYKVYSI

SEQ ID NO: 802904 - protein, 344 aa, Homo sapiens
PNRPPPTPRSGPGLRRKPRRRRRRRRRRAGEEDGRSGFRLSPQHRTRRRERRGEREVDEGEATSLPGPCAAHVAGAAEDEDDEEQAVAAAPHAHKATANPPPGSAGRAAAIARDSQRHFWNIFGKNCRIQVILPSSGRLLEIILEAFWQELNLFLLLPVKPCLDLLVNWLHIYLNNQDSGTKAFCNVALHGPFYSACQAVFYTFVFRHKQLLSGNLKEGLQYLQSLNFERIVMSQLNPLKICLPSVVNFFAAITNKYQLVFCYTIIERNNRQMLPVIRSTTGGDSVQTCTNPLDTFVPFDPCVLKRSKKFIDPIYQVWEDMSAEEAFSWEHVLSDAATLLQSER

SEQ ID NO: 802905 - protein, 158 aa, Homo sapiens
PNRPPPTPRSGPGLRRKPRRRRRRRRRRAGEEDGRSGFRLSPQHRTRRRERRGEREVDEGEATSLPGPCAAHVAGAAEDEDDEEQAVAAAPHAHKATANPPPGSAGRAAAIARDSQRHFWNIFGKNCRIQVILPSSGRLLEIILEAFWQELNLFLLLL

SEQ ID NO: 802906 - protein, 347 aa, Homo sapiens
PNRPPPTPRSGPGLRRKPRRRRRRRRRRAGEEDGRSGFRLSPQHRTRRRERRGEREVDEGEATSLPGPCAAHVAGAAEDEDDEEQAVAAAPHAHKATANPPPGSAGRAAAIARDSQRHFWNIFGKNCRIQVILPSSGRLLEIILEAFWQELNLFLLLPVKPCLDLLVNWLHIYLNNQDSGTKAFCNVALHGPFYSACQAVFYTFVFRHKQLLSGNLKEGLQYLQSLNFERIVMSQLNPLKICLPSVVNFFAAITNKYQLVFCYTIIERNNRQMLPVIRSTTGGDSVQTCTNPLDTFVPFDPCVLKRFFNLLLSLGRHLLDRNTELEGLCQQNVIQAIRSSDRKLSIV

SEQ ID NO: 802907 - protein, 156 aa, Homo sapiens
PNRPPPTPRSGPGLRRKPRRRRRRRRRRAGEEDGRSGFRLSPQHRTRRRERRGEREVDEGEATSLPGPCAAHVAGAAEDEDDEEQAVAAAPHAHKATANPPPGSAGRAAAIARDSQRHFWNIFGKNCRIQVILPSSGRLLEIILEAFWQELNLFLL

SEQ ID NO: 802908 - protein, 158 aa, Homo sapiens; identical to SEQ ID NO: 802905

SEQ ID NO: 802909 - protein, 338 aa, Homo sapiens
PNRPPPTPRSGPGLRRKPRRRRRRRRRRAGEEDGRSGFRLSPQHRTRRRERRGEREVDEGEATSLPGPCAAHVAGAAEDEDDEEQAVAAAPHAHKATANPPPGSAGRAAAIARDSQRHFWNIFGKNCRIQVILPSSGRLLEIILEAFWQELNLFLLLPVKPCLDLLVNWLHIYLNNQDSGTKAFCNVALHGPFYSACQAVFYTFVFRHKQLLSGNLKEGLQYLQSLNFERIVMSQLNPLKICLPSVVNFFAAITNKYQLVFCYTIIERNNRQMLPVIRSTTGGDSVQTCTNPLDTFVPFDPCVLKRSKKFIDPIYQVWEDMSAEELQEFKKPMKKVSL

SEQ ID NO: 802910 - protein, 158 aa, Homo sapiens; identical to SEQ ID NO: 802905

SEQ ID NO: 802911 - protein, 83 aa, Homo sapiens
INDVGAPGDTPVHTGTHRCTHTCTCTHLHMHARTGACMHLWAVPEHRRGRWCAGGSVEAPLPPSKLGPQPPPATRVFAQMEWR

SEQ ID NO: 802912 - protein, 110 aa, Homo sapiens
ARGARCFRSLEKSFSGQCLPSAHSSNLISAVKPESCYLEGGGDPPGSGTKSDSVMVSEAPVVVSTQTRAAVEAVRAPTGTLVYCVIAAIRKVASSDGPIWGIKPVRWCQP

SEQ ID NO: 802913 - protein, 109 aa, Homo sapiens
MRALLPLLSAGATACVRDPWPDLSAPDNRKSLFRLKKKKKKKKACGRLSRTQEAQNWEKSLWLGLFQVSGSMGCSKPGLGSSEGWTSLELDRTLKTGFLVLITYMGYNE

SEQ ID NO: 802914 - protein, 204 aa, Homo sapiens
MGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 802915 - protein, 253 aa, Homo sapiens
MNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 802916 - protein, 138 aa, Homo sapiens
MPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 802917 - protein, 138 aa, Homo sapiens; identical to SEQ ID NO: 802916

SEQ ID NO: 802918 - protein, 109 aa, Homo sapiens
MGGAQLGLYLLLGQAPARALQQQGHLRIHGLNQPPGPSGSAPSPKRKCPPPFHAAFHWRVRRGRGSWRFVPAAPTLPPGPSARRPCLPDHPAGRTSDLGCGARPPCAPG

SEQ ID NO: 802919 - protein, 138 aa, Homo sapiens; identical to SEQ ID NO: 802916

SEQ ID NO: 802920 - protein, 138 aa, Homo sapiens; identical to SEQ ID NO: 802916

SEQ ID NO: 802921 - protein, 136 aa, Homo sapiens
MPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRENHHPSPYSLFLKAVPFCPHLSPSFQP

SEQ ID NO: 802922 - protein, 160 aa, Homo sapiens
MPLETPQALPPMLVHGTFWKHWPSILLKGLSCQGRTHIHLAPGLPGDPGIISGMRSHCEIAVFIDGPLALAGELDKAGAALAFGEGMSHISGSVSNGIPFFRSANGVILTPGNTDGFLLPKYFKEALQLRPTRENHHPSPYSLFLKAVPFCPHLSPSFQP

SEQ ID NO: 802923 - protein, 122 aa, Homo sapiens
MPLETPQALPPMLVHGTFWKHWPSILLKGLSCQGRTHIHLAPGLPGDPGIISGMRSHCEIAVFIDGPLALAGNTDGFLLPKYFKEALQLRPTRKPLSLAGDEETECQSSPKHSSRERRRIQQ

SEQ ID NO: 802924 - protein, 61 aa, Homo sapiens
MPLETPQALPPMLVHGTFWKHWPSILLKGLSCQGRTHIHLAPGLPGDPGIISARQGSSRVY

SEQ ID NO: 802925 - protein, 253 aa, Homo sapiens; identical to SEQ ID NO: 802915

SEQ ID NO: 802926 - protein, 138 aa, Homo sapiens; identical to SEQ ID NO: 802916

SEQ ID NO: 802927 - protein, 288 aa, Homo sapiens
MGGAQLGLYLLLGQAPARALQQQGHLRIHGLNVLTMNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 802928 - protein, 138 aa, Homo sapiens; identical to SEQ ID NO: 802916

SEQ ID NO: 802929 - protein, 136 aa, Homo sapiens; identical to SEQ ID NO: 802921

SEQ ID NO: 802930 - protein, 162 aa, Homo sapiens
MPLETPQALPPMLVHGTFWKHWPSILLKGLSCQGRTHIHLAPGLPGDPGIISGMRSHCEIAVFIDGPLALAGELDKAGAALAFGEGMSHISGSVSNGIPFFRSANGVILTPGNTDGFLLPKYFKEALQLRPTRKPLSLAGDEETECQSSPKHSSRERRRIQQ

SEQ ID NO: 802931 - protein, 82 aa, Homo sapiens
RIGGSAARPAAVEDPGGLSPPPRRFRPVRRHVGPASRTTLRGAPAIWGAGLGLPALLADGVTLGLNHELLWRREAGSSRVQG

SEQ ID NO: 802932 - protein, 125 aa, Homo sapiens
RIGGSAARPAAVEDPGGLSPPPRRFRPVRRHVGPASRTTLRGAPAIWGAGLGLPALLADGVTLGPRRAAVQGSVLCPAPWGLEAGASHGSWSPSKVTTLVWGHPMSGMEQHPCIPQPRTPVCLGC

SEQ ID NO: 802933 - protein, 140 aa, Homo sapiens
MAIKAHQAPATFPTPHSFLLPPSTPGMFPATPCCSPHLGCPPNSSLPLEMLCHSRLGSGSRSSLGLLEPLVLTPLNTSSLANSPLHPGLGYRWPAQVWGPASNTSTGRSLCRPWAARGPALPTAGALRRAGHEAGGCPPI

SEQ ID NO: 802934 - protein, 82 aa, Homo sapiens
PHKRRTGYRCARPGRGLVPADGTDEVTKPRPRRRGCQGLGNPPPPVPIPLSFGVSPQRTRQHSCSFLILKMDCTFWHLKWFL

SEQ ID NO: 802935 - protein, 82 aa, Homo sapiens; identical to SEQ ID NO: 802934

SEQ ID NO: 802936 - protein, 418 aa, Homo sapiens
MRLSAGPDAGPSGNSSPWWPLATGAGNTSREAEALGEGNGPPRDVRNEELAKLEIAVLAVTFAVAVLGNSSVLLALHRTPRKTSRMHLFIRHLSLADLAVAFFQVLPQMCWDITYRFRGPDWLCRVVKHLQVFGMFASAYMLVVMTADRYIAVCHPLKTLQQPARRSRLMIAAAWVLSFVLSTPQYFVFSMIEVNNVTKARDCWATFIQPWGSRAYVTWMTGGIFVAPVVILGTCYGFICYNIWCNVRGKTASRQSKGAEQAGVAFQKGFLLAPCVSSVKSISRAKIRTVKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTGMWKDSPKSSKSIKFIPVST

SEQ ID NO: 802937 - protein, 682 aa, Homo sapiens
GSGVCGGDPVVSSSYRSVGCSEQQKPASSDVVLPATMSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIQQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 802938 - protein, 243 aa, Homo sapiens [sequence omitted]

SEQ ID NO: 802939 - protein, 394 aa, Homo sapiens
GSGVCGGDPVVSSSYRSVGCSEQQKPASSDVVLPATMSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGEFSWGAWC

SEQ ID NO: 802940 - protein, 486 aa, Homo sapiens
GSGVCGGDPVVSSSYRSVGCSEQQKPASSDVVLPATMSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTASGGTGARHR

SEQ ID NO: 802941 - protein, 486 aa, Homo sapiens
GRVGRPTRRRSVGCSEQQKPASSDVVLPATMSYTGFVQGSETTLQSTYSDTSAQPTCDYGYGTWNSGTNRGKCHPVIAVLSLGVVLAVFLCHCPAWPRLGVGRGHVSGVTYSLTGGPHQNDQGPSSFSGYGSSLSVTEDTLVSVFVSVSVCLPSACPHHLSVSVSLTAGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGEFSWGAWC

SEQ ID NO: 802942 - protein, 243 aa, Homo sapiens [sequence omitted]

SEQ ID NO: 802943 - protein, 243 aa, Homo sapiens [sequence omitted]

SEQ ID NO: 802944 - protein, 387 aa, Homo sapiens
LLGHSRGSSAASSTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIQQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 802945 - protein, 265 aa, Homo sapiens
GGGGVTNKLSISVQNNRSVRHINGGCVGRKVGCMQNWRLSEKAEHIPRHRMRRYFSQSEHEKKELRKTVEDLDGLIQQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 802946 - protein, 179 aa, Homo sapiens
MDDPKLHGNEEVQAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 802947 - protein, 119 aa, Homo sapiens
RDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRVSGGSLPLWEA

SEQ ID NO: 802948 - protein, 70 aa, Homo sapiens
APALALASSASDSCSCWTFLSLAGARPLGSPDKADPVAQIRTSGRGRDPPRGLGGGWPPPPLATAACSGP

SEQ ID NO: 802949 - protein, 422 aa, Homo sapiens
GSGVCGGDPVVSSSYRSVGCSEQQKPASSDVVLPATMSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVER

SEQ ID NO: 802950 - protein, 676 aa, Homo sapiens
GRVGRPTRRRSVGCSEQQKPASSDVVLPATMSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIQQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 802951 - protein, 243 aa, Homo sapiens [sequence omitted]

SEQ ID NO: 802952 - protein, 394 aa, Homo sapiens; identical to SEQ ID NO: 802939

SEQ ID NO: 802953 - protein, 381 aa, Homo sapiens
GSGVCGGDPVVSSSYRSVGCSEQQKPASSDVVLPATMSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVVSGSGWAFSVCRQGELA

SEQ ID NO: 802954 - protein, 243 aa, Homo sapiens [sequence omitted]

SEQ ID NO: 802955 - protein, 243 aa, Homo sapiens [sequence omitted]

SEQ ID NO: 802956 - protein, 243 aa, Homo sapiens [sequence omitted]

SEQ ID NO: 802957 - protein, 424 aa, Homo sapiens
RYQMSRELPQIPEGRCSTFSGPASGLRTPLCTSGPPGSRQGILPSGPHLGQVHTLLPSLGSEALQQLSSDSLPVAAAAVSGFSLLPVGRKSSSPVPYVAVTAACRLSGPFYSRPPGPSLSLCWDRTSEAREQGLFQGLCLGWVRRQHYPWDTCSLSPSFPSCGRIQFVCSLCKYRTFYEDEMASHLDSKFHKEHFKYVGTKLPKQTADFLQEYVTNKTKKTEELRKTVEDLDGLIQQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 802958 - protein, 120 aa, Homo sapiens
GRVGRPTRRRSVGCSEQQKPASSDVVLPATMSYTGFVQGSETTLQSTYSDTSAQPTCDYGYGTWNSGTNRGKCHSCDCCPVPWGCPGCVSLPLPCLAKVGSGEGACFWGYLLLNRRPSSE

SEQ ID NO: 802959 - protein, 154 aa, Homo sapiens
LPHGGPQYSQQQAHQQEAGALPEGEALVRACPVPSLVPACAPSLQCPRPSPQGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 802960 - protein, 65 aa, Homo sapiens
RPVGGRLAGGARAVEGPVVADGGHQARGPHLAAVVDEEEQAEVDEVRGAHHHGQQQQEAQRAGGA

SEQ ID NO: 802961 - protein, 118 aa, Homo sapiens
MRGERRPLWEEESNAKGGVWKMKVPKDSTSTVWKELLLATIGEQFTDCAAADDEVIGVSVSVRDREDVVQVWNVNASLVGEATVLEKIYELLPHITFKAVFYKPHEEHHAFEGGRGKH

SEQ ID NO: 802962 - protein, 118 aa, Homo sapiens; identical to SEQ ID NO: 802961

SEQ ID NO: 802963 - protein, 280 aa, Homo sapiens
MALAVSRAAPTSVLTQGAGAPLRISPPHKPDLLGSPSRPPALGRCTQQGLLNSLRLRFPLSLLGYKQIPRGEKSRLTQPPAPLPWEATPRLPLEPTTGEHCLQSSLSLGKFRSHISLDPPRPGWTALVCLELGPSLGSCLRVGGLSSLFECSTRSRKRAVCSGQWFLGHCMVLASLQGPPSLAAASQPRAGPFCQLKAERPAALGWRRAEKPPGVVSVLLKVMLTPVSQAAGRVAVRSVVTGLHHCGLPPREQLCPTTASLQLLPSAWAGAEPGVWVGEA

SEQ ID NO: 802964 - protein, 476 aa, Homo sapiens
MQGISEHCAGSPASPSSGVDTGRFCHMTYPKPRLKDLLPRTRPLPQGDLKAFSPPCLSVPIHTLGTAPCSPAASQAGLCSCSPHPAWRPGQKDAEVAERADGLAGRADLLHGAGILLRQRQMMDCTWTLPGMRATWQPAPFLPWDQTPWRVSFSWSPVLLAWGGVWSGEAHPCAHVLRPPASPCPPRPRRGCGDSGSSGMAQRAQAGSNQSRGKCGRDGRCPPRSSPGAPEAAERVESAETRGPGKSWILSPSSMSEPRRGKARRSPGRRRHPHSSFPQASSPSSPSRRETIPQVQSSGVPGAMSPEQTLFSRSPRGLSHLGQSLCRTVKESEAQRGKTMPPGSHSPSGAGQGRTARKGPAREEIPSSDSSAKPSVYPHPHLTATRWGRHHCPFSKVRKQRLREVQQLLPQLLRCRTAVPGVPELSLPEPSAPALLSEPWPSQSKPGSGCSEALGLVNPSCLGPGPPPGGDPEGCS

SEQ ID NO: 802965 - protein, 450 aa, Homo sapiens
MTYPNQRLKDLLPRTRPLPQGDLKAFSPPCLSVPIHTLGTAPCSPAASQAGLCSCSPHPAWRPGQKDAEVAERADGLAGRADLLHGAGILLRQRQMMDCTWTLPGMRATWQPAPFLPWDQTPWRVSFSWSPVLLAWGGVWSGEAHPCAHVLRPPASPCPPRPRRGCGDSGSSGMAQRAQAGSNQSRGKCGRDGRCPPRSSPGAPEAAERVESAETRGPGKSWILSPSSMSEPRRGKARRSPGRRRHPHSSFPQASSPSSPSRRETIPQVQSSGVPGAMSPEQTLFSRSPRGLSHLGQSLCRTVKESEAQRGKTMPPGSHSPSGAGQGRTARKGPAREEIPSSDSSAKPSVYPHPHLTATRWGRHHCPFSKVRKQRLREVQQLLPQLLRCRTAVPGVPELSLPEPSAPALLSEPWPSQSKPGSGCSEALGLVNPSCLGPGPPPGGDPEGCS

SEQ ID NO: 802966 - protein, 497 aa, Homo sapiens
MSWEAGALGGWSPRCSGSCSWMQGISEHCAGSPASPSSGVDTGRFCHMTYPNQRLKDLLPRTRPLPQGDLKAFSPPCLSVPIHTLGTAPCSPAASQAGLCSCSPHPAWRPGQKDAEVAERADGLAGRADLLHGAGILLRQRQMMDCTWTLPGMRATWQPAPFLPWDQTPWRVSFSWSPVLLAWGGVWSGEAHPCAHVLRPPASPCPPRPRRGCGDSGSSGMAQRAQAGSNQSRGKCGRDGRCPPRSSPGAPEAAERVESAETRGPGKSWILSPSSMSEPRRGKARRSPGRRRHPHSSFPQASSPSSPSRRETIPQVQSSGVPGAMSPEQTLFSRSPRGLSHLGQSLCRTVKESEAQRGKTMPPGSHSPSGAGQGRTARKGPAREEIPSSDSSAKPSVYPHPHLTATRWGRHHCPFSKVRKQRLREVQQLLPQLLRCRTAVPGVPELSLPEPSAPALLSEPWPSQSKPGSGCSEALGLVNPSCLGPGPPPGGDPEGCS

SEQ ID NO: 802967 - protein, 1104 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802968 - protein, 292 aa, Homo sapiens
MYVNMKSAVFLQAGTVGISGLRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQ

SEQ ID NO: 802969 - protein, 156 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSDHPRSSVQHSPLPQPTLFPAQDRR

SEQ ID NO: 802970 - protein, 827 aa, Homo sapiens
VLEDPCNPYSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802971 - protein, 1148 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVGQETGGRKGPKVGQDELFSYAFKAHARTQGVSYHSPAPCAPPQVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802972 - protein, 1072 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEELRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802973 - protein, 1092 aa, Homo sapiens [sequence omitted]

SEQ ID NO: 802974 - protein, 1104 aa, Homo sapiens; identical to SEQ ID NO: 802967

SEQ ID NO: 802975 - protein, 749 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGAILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802976 - protein, 392 aa, Homo sapiens
MESGLLGSHHLAFVLIFLFNRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802977 - protein, 1104 aa, Homo sapiens; identical to SEQ ID NO: 802967

SEQ ID NO: 802978 - protein, 1104 aa, Homo sapiens; identical to SEQ ID NO: 802967

SEQ ID NO: 802979 - protein, 1104 aa, Homo sapiens; identical to SEQ ID NO: 802967

SEQ ID NO: 802980 - protein, 864 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQ

SEQ ID NO: 802981 - protein, 647 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPWYRLLRGAVPGIQ

SEQ ID NO: 802982 - protein, 397 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEPIFLPKCLGC

SEQ ID NO: 802983 - protein, 1114 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPMVTSELYPPQLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802984 - protein, 830 aa, Homo sapiens
AGTGLECLGSGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802985 - protein, 843 aa, Homo sapiens
MLDTKMHLTVDSVRERLPNSTVEPAPVSLHLTKVTSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802986 - protein, 1132 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRLRPHPSCPPDRLHPFPQVTISPTSSCCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802987 - protein, 1094 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGSESIGVYVKNRLGLFKAMESGLLGSHHLAFVLIFLFNRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802988 - protein, 1104 aa, Homo sapiens; identical to SEQ ID NO: 802967

SEQ ID NO: 802989 - protein, 1104 aa, Homo sapiens; identical to SEQ ID NO: 802967

SEQ ID NO: 802990 - protein, 303 aa, Homo sapiens
LRLTQYCLSQLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 802991 - protein, 1104 aa, Homo sapiens; identical to SEQ ID NO: 802967

SEQ ID NO: 802992 - protein, 143 aa, Homo sapiens
LLVLLRVGAESPIQTGLPFKKSKVHMVFPTTVVNSLSSAEHSNSSCTSFLLRSVFRMTRFPRTICSNSALKQVSLTALSSCLRLAPSPPQCDEPKARVQGQSLCPSALSPNRPIFGPLPDQREEPYVPFTARPLSFWAPGAGT

SEQ ID NO: 802993 - protein, 441 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDPIFLPKCLGC

SEQ ID NO: 802994 - protein, 78 aa, Homo sapiens
MGKCEVGKTKAEKVWEDRRGTFLGKGFDFLFLPQLHGVLRVILEPLIGDLPFVGAVSMFFIRRPVRENNEGVWGSRRN

SEQ ID NO: 802995 - protein, 80 aa, Homo sapiens
LLLSHRRIHSDSRPFPCVECGKGFKRKTALEAHRWIHRSCSERRAWQQAVVGRSEPIPVLGGKDPPVHFRHFPDIFQECG

SEQ ID NO: 802996 - protein, 80 aa, Homo sapiens; identical to SEQ ID NO: 802995

SEQ ID NO: 802997 - protein, 80 aa, Homo sapiens; identical to SEQ ID NO: 802995

SEQ ID NO: 802998 - protein, 80 aa, Homo sapiens; identical to SEQ ID NO: 802995

SEQ ID NO: 802999 - protein, 80 aa, Homo sapiens; identical to SEQ ID NO: 802995

SEQ ID NO: 803000 - protein, 80 aa, Homo sapiens; identical to SEQ ID NO: 802995

SEQ ID NO: 803001 - protein, 186 aa, Homo sapiens
ASVEPYDSIRVALRGQKVIDTMDLCVLLNVEKSRWITLHFRCMGTVFHLSEKDPRGSETLHACCEQILNEKLREKARLYAGVVLNEMRSNAKSQTMVGFGPEDDHFVAELTYNYGVGDYKLGNDFMGITLASSQAVSNARKLEWPLTEVAEGVFETEAPGGYKFYLQNRSLPQSDPVLKVTLAVSD

SEQ ID NO: 803002 - protein, 298 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 803003 - protein, 307 aa, Homo sapiens
QAVLAPIPMMAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 803004 - protein, 313 aa, Homo sapiens
MAARRALHFVFKVGNRFQTARFYRDVLGMKVESCSVARLECSGAISAHCSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 803005 - protein, 289 aa, Homo sapiens
MRNLKKAAKLPVMGMIPCFLKSPLGSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 803006 - protein, 188 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQVSNLGEE

SEQ ID NO: 803007 - protein, 242 aa, Homo sapiens
MVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 803008 - protein, 242 aa, Homo sapiens; identical to SEQ ID NO: 803007

SEQ ID NO: 803009 - protein, 138 aa, Homo sapiens [sequence omitted]

SEQ ID NO: 803010 - protein, 188 aa, Homo sapiens; identical to SEQ ID NO: 803006

SEQ ID NO: 803011 - protein, 240 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLAKKKKKKKKFVGGAWARKSFLNHTSVGAGPELGDWATGLQGEPGRNGAASPIKTPGDRRSDNPWVGAPAYQGSDRIARRVG

SEQ ID NO: 803012 - protein, 240 aa, Homo sapiens
MRLTPFSLSTGNSFRYSRRLKKNIFGTAPALRVSEMSLRPSSRIFPCFSRNGLDFTIVITLAQPPVPGISFIVAKPRLFPGAGSAGCGLLERLFLSLLLGTGLRWCLAGLLPRSALLFHHLSGRTHHFHWAPPQRTDPAPRSRSQAWTTCSNGRTTNLAGLTSAAMFPETRAASRKRAVGHSDVTARGALRGLGCTVRVTAACGGNHGCSQSSALRIQSGKPLPDGAFLSGRPGDEGSAA

SEQ ID NO: 803013 - protein, 298 aa, Homo sapiens; identical to SEQ ID NO: 803002

SEQ ID NO: 803014 - protein, 298 aa, Homo sapiens; identical to SEQ ID NO: 803002

SEQ ID NO: 803015 - protein, 295 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDVNGRHDAEQASVIPAQHL

SEQ ID NO: 803016 - protein, 298 aa, Homo sapiens; identical to SEQ ID NO: 803002

SEQ ID NO: 803017 - protein, 242 aa, Homo sapiens; identical to SEQ ID NO: 803007

SEQ ID NO: 803018 - protein, 286 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAALWCPGDK

SEQ ID NO: 803019 - protein, 407 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGTMNNSALVGGMTHSRATFLRWIPEGRHSSACCTWQQIQRDEWLANTTKSLPYSVQGYRGTTVDGTQNRPLVISMAPCHHLLIGATCTLWFKRHRRTVIPGLRFLELVGCTPVSRGHGTGICALSCRRTSRDTFRELSCEQRSCTVNISTKTAQRSNH

SEQ ID NO: 803020 - protein, 147 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSD

SEQ ID NO: 803021 - protein, 83 aa, Homo sapiens
ALHFVFKVGNRFQTARFYRDVLGMKVQAGADRGWRARLEPAPEPALAEGGENGCVVNLSRRVSDLRPCAVFSFRSVASCRWGS

SEQ ID NO: 803022 - protein, 226 aa, Homo sapiens
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKELHAENLKNEDDVDTGLLGFWTLLIISLTAGFSCCSFSWTVTYFDSFEPGMFPPTPLSPARFKKLTGHSFHMGYSMAILNGIVAALTVAWCLM

SEQ ID NO: 803023 - protein, 120 aa, Homo sapiens
RCSRRRGGGGEGERRGSEERVRSPYAPELHAENLKNEDDVDTGLLGFWTLLIISLTAGFSCCSFSWTVTYFDSFEPGMFPPTPLSPARFKKLTGHSFHMGYSMAILNGIVAALTVAWCLM

SEQ ID NO: 803024 - protein, 229 aa, Homo sapiens
MGEPGEECERSGEEGRRQIGSGPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKELHAENLKNEDDVDTGLLGFWTLLIISLTAGFSCCSFSWTVTYFDSFEPGMFPPTPLSPARFKKLTGHSFHMGYSMAILNGIVAALTVAWCLM

SEQ ID NO: 803025 - protein, 134 aa, Homo sapiens
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKD

SEQ ID NO: 803026 - protein, 149 aa, Homo sapiens
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKAFSGLQMAWHLKPYNA

SEQ ID NO: 803027 - protein, 164 aa, Homo sapiens
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKELHAENLKNEDDVDTGLLGIICISRKFSLML

SEQ ID NO: 803028 - protein, 120 aa, Homo sapiens; identical to SEQ ID NO: 803023

SEQ ID NO: 803029 - protein, 143 aa, Homo sapiens
VSQLPELRRSITVGGGAVGVCHLHPPRPSYVRPTNLRPPGVGWRGRGGTAGVKAKSTRRRDATKWPATCGRSSRLGRGQSPESARCSRRTGTGRPFCPISAMVSFPRPRAAEPSLGGGRSRSSLFSARCSSPFFSPSSSPSPT

SEQ ID NO: 803030 - protein, 166 aa, Homo sapiens
MGEPGEECERSGEEGRRQIGSGMCLRGRERALGPGVEKMRLWGCRGARSVGDAGVAEVSGRDEAPQGVDTRQPSASARFSLRAFLLPFPATALGSSSGRSAFRLSFGPAASFATRRPPLLSVVYPWALRPGGSGHCRGLAVADPGRGRWERLVLRGFRCVSRHVVC

SEQ ID NO: 803031 - protein, 156 aa, Homo sapiens
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKELHAENLKNEDDVDTGLLAFLGQ

SEQ ID NO: 803032 - protein, 208 aa, Homo sapiens
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKGFWTLLIISLTAGFSCCSFSWTVTYFDSFEPGMFPPTPLSPARFKKLTGHSFHMGYSMAILNGIVAALTVAWCLM

SEQ ID NO: 803033 - protein, 118 aa, Homo sapiens [sequence omitted]

SEQ ID NO: 803034 - protein, 236 aa, Homo sapiens
RYLWFWLFYYNIGNYYTGFISSPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAEGDWTVSLEHILASLLTEQSLVNFFEKPLDMKSKLENAKINQYNLKTFEMSHQSQSELKLSNL

SEQ ID NO: 803035 - protein, 146 aa, Homo sapiens
HWYRQGMREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQ

SEQ ID NO: 803036 - protein, 1155 aa, Homo sapiens
KQDARGGGPAALEWGLIPGDAAKSLPVWACGGKVSLNVDGTVGRLVGALDAVLDSNARVAPFRILLQVPGSQVYSPIACGELLNGSDVYWAIATGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTAGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAEGDWTVSLEHILASLLTEQSLVNFFEKPLDMKSKLENAKINQYNLKTFEMSHQSQSELKLSNL

SEQ ID NO: 803037 - protein, 1140 aa, Homo sapiens
KQDARGGGPAALEWGLIPGDAAKSLPVWACGGKVSLNVDGTVGRLVGALDAVLDSNARVAPFRILLQVPGSQVYSPIACGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTAGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAEGDWTVSLEHILASLLTEQSLVNFFEKPLDMKSKLENAKINQYNLKTFEMSHQSQSELKLSNL

SEQ ID NO: 803038 - protein, 1019 aa, Homo sapiens
KQDARGGGPAALEWGLIPGDAAKSLPVWACGGKVSLNVDGTVGRLVGALDAVLDSNARVAPFRILLQVPGSQVYSPIACGELLNGSDVYWAIATGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTAGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGTYLFSLLLSPAYHCSGGRHQGCPHPSSCSSLVFSLRPMNYPQTHCL

SEQ ID NO: 803039 - protein, 171 aa, Homo sapiens [sequence omitted]

SEQ ID NO: 803040 - protein, 673 aa, Homo sapiens
VVPEFVVVVPEFVVVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGTYLFSLLLSPAYHCSGGRHQGCPHPSSCSSLVFSLRPMNYPQTHCL

SEQ ID NO: 803041 - protein, 300 aa, Homo sapiens
CVDGAEVCEDCATDDGRLMISEFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGTYLFSLLLSPAYHCSGGRHQGCPHPSSCSSLVFSLRPMNYPQTHCL

SEQ ID NO: 803042 - protein, 1019 aa, Homo sapiens; identical to SEQ ID NO: 803038

SEQ ID NO: 803043 - protein, 70 aa, Homo sapiens
MNDLSALASVSLSWFLTLFLSIMPLESAVNVVDCFFYDGIKAIFQLGLAVLEANAEDLCSSKDDGQALMI

SEQ ID NO: 803044 - protein, 1076 aa, Homo sapiens
MTQLSHSPRQVCLSLKQRTLLGGLCTSVPPASCPLHPLPSHCWLTEQVTVISVCQALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTAGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAEGDWTVSLEHILASLLTEQSLVNFFEKPLDMKSKLENAKINQYNLKTFEMSHQSQSELKLSNL

SEQ ID NO: 803045 - protein, 138 aa, Homo sapiens [sequence omitted]

SEQ ID NO: 803046 - protein, 191 aa, Homo sapiens
MNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYENLETRLERNRYRAR

SEQ ID NO: 803047 - protein, 59 aa, Homo sapiens
RYPDIFFFRPYAEQYRIDARQFAHLFQLVSPWTCGALVEVDKKGNDECPGTNRCRKKKM

SEQ ID NO: 803048 - protein, 412 aa, Homo sapiens
MNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGTYLFSLLLSPAYHCSGGRHQGCPHPSSCSSLVFSLRPMNYPQTHCL

SEQ ID NO: 803049 - protein, 979 aa, Homo sapiens
KQDARGGGPAALEWGLIPGDAAKSLPVWACGGKVSLNVDGTVGRLVGALDAVLDSNARVAPFRILLQVPGSQVYSPIACGELLNGSDVYWAIATGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTAGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQ

SEQ ID NO: 803050 - protein, 657 aa, Homo sapiens
KQDARGGGPAALEWGLIPGDAAKSLPVWACGGKVSLNVDGTVGRLVGALDAVLDSNARVAPFRILLQVPGSQVYSPIACGELLNGSDVYWAIATGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTAGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQVKGVCSGAQRVFSWCLMLSFPGFHLHSQSSGPECCRVKALYSVPFRKESIK

SEQ ID NO: 803051 - protein, 98 aa, Homo sapiens
PYAEQYRIDARQFAHLFQLVSPWTCGAHTEILAERTFRLLDDNMDQLIEFKAFVSCLGMPLWDFAVMCFGVWVCEQNTKWIFGAGRCTWCNTFVTGLT

SEQ ID NO: 803052 - protein, 239 aa, Homo sapiens
RPGRLQWGRAAMGPGRRKQVRQSWGADRPKGILAWPDSQECGPAQESPSPPELRERGGSKARPAGQREARPGRPRGSGGDPRAGQVAGSAEGSGSRGTARGEGAARAALTLGDPAEAQDVLGPDGVQRQQLLLRDRCPDAVVGRVVGRLPPRLQAVQDAAAAFFFSSLPATSPPGPSRRRRGRSLRVRPAHRSAAKMAAASTARDDGKCNLFTCNSTSRNLPYLHAQRFVILTNYNKLH

SEQ ID NO: 803053 - protein, 187 aa, Homo sapiens
RPGRLQWGRAAMGPGRRKQVRQSWGADRPKGILAWPDSQECGPAQESPSPPELRERGGSKARPAGQREARPGRPRGSGGDPRAGQVAGSAEGSGSRGTARGEGAARAALTLGDPAEAQDVLGPDGVQRQQLLLRDRCPDAVVGRVVGRLPPRLQAVQDAAARLLLLLLASHQPPRAQPPTPRPQPSG

SEQ ID NO: 803054 - protein, 101 aa, Homo sapiens
CSMDVTVSTESSCNRSRACSGLRLYSGSDQTGEEDGGQVVGERTRRSHDQESSRQCVGLCFVKQQRALKLERAKALRRADRGKKILNANVSSRLPVFRVSY

SEQ ID NO: 803055 - protein, 68 aa, Homo sapiens
TRMKLGLTMHTSLFSWVSFSKETSATSSPPAILSPTSPLSRITSTCSRPATCSNEGRQKHFSRFGNKA

SEQ ID NO: 803056 - protein, 866 aa, Homo sapiens
MPAVSLPPKENALFKRILRCYEHKQYRNGLKFCKQILSNPKFAEHGETLAMKGLTLNCLGKKEEAYELVRRGLRNDLKSHVCWHVYGLLQRSDKKYDEAIKCYRNALKWDKDNLQILRDLSLLQIQMRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERHFIEITDDQFDFHTYCMRKITLRSYVDLLKLEDVLRQHPFYFKAARIAIEIYLKLHDNPLTDENKEHEADTANMSDKELKKLRNKQRRAQKKAQIEEEKKNAEKEKQQRNQKKKKDDDDEEIGGPKEELIPEKLAKVETPLEEAIKFLTPLKNLVKNKIETHLFAFEIYFRKEKFLLMLQSVKRAFAIDSSHPWLHECMIRLFNTAVCESKDLSDTVRTVLKQEMNRLFGATNPKNFNETFLKRNSDSLPHRLSAAKMVYYLDPSSQKRAIELATTLDESLTNRNLQTCMEVLEALYDGSLGDCKEAAEIYRANCHKLFPYALAFMPPGYEEDMKITVNGDSSAEAEELANEI

SEQ ID NO: 803057 - protein, 866 aa, Homo sapiens; identical to SEQ ID NO: 803056

SEQ ID NO: 803058 - protein, 866 aa, Homo sapiens; identical to SEQ ID NO: 803056

SEQ ID NO: 803059 - protein, 866 aa, Homo sapiens; identical to SEQ ID NO: 803056

SEQ ID NO: 803060 - protein, 866 aa, Homo sapiens; identical to SEQ ID NO: 803056

SEQ ID NO: 803061 - protein, 898 aa, Homo sapiens
MPAVSLPPKENALFKRILRCYEHKQYRNGLKFCKQILSNPKFAEHGETLAMKGLTLNCLGKKEEAYELVRRGLRNDLKSHVCWHVYGLLQRSDKKYDEAIKCYRNALKWDKDNLQILRDLSLLQIQMRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNAFSYIFYKCGRGSDDLPKNMQHFCCRSVRWGVDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERHFIEITDDQFDFHTYCMRKITLRSYVDLLKLEDVLRQHPFYFKAARIAIEIYLKLHDNPLTDENKEHEADTANMSDKELKKLRNKQRRAQKKAQIEEEKKNAEKEKQQRNQKKKKDDDDEEIGGPKEELIPEKLAKVETPLEEAIKFLTPLKNLVKNKIETHLFAFEIYFRKEKFLLMLQSVKRAFAIDSSHPWLHECMIRLFNTAVCESKDLSDTVRTVLKQEMNRLFGATNPKNFNETFLKRNSDSLPHRLSAAKMVYYLDPSSQKRAIELATTLDESLTNRNLQTCMEVLEALYDGSLGDCKEAAEIYRANCHKLFPYALAFMPPGYEEDMKITVNGDSSAEAEELANEI

SEQ ID NO: 803062 - protein, 919 aa, Homo sapiens
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 803063 - protein, 435 aa, Homo sapiens [sequence omitted]

SEQ ID NO: 803064 - protein, 559 aa, Homo sapiens
MKLTLVMTYLIQSHHSRRSQNCAEDVIRKTKTDQNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 803065 - protein, 969 aa, Homo sapiens
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAEMYSSCINLSSNMLIEEHLCNDTRHNDINRKMKKSYSIKHIAEPESKELFL

SEQ ID NO: 803066 - protein, 947 aa, Homo sapiens [sequence omitted]

SEQ ID NO: 803067 - protein, 221 aa, Homo sapiens
MASSTSLPAPGSRPKKPLGKMADWFRQTLLKKPKKRPNSPESTSSDASQPTSQDSPLPPSLSSVTSPSLPPTHASDSGSSRWSKDYDVCVCHSEEDLVAAQDLVSYLEGSTASLRCFLQLRDATPGGAIVSELCQALSSSHCRVLLITPGFLQDPWCKYQMLQALTEAPGAEGCTIPLLSGLSRAAYPPELRFMYYVDGRGPDGGFRQVKEAVMRYLQTLS

SEQ ID NO: 803068 - protein, 221 aa, Homo sapiens; identical to SEQ ID NO: 803067

SEQ ID NO: 803069 - protein, 221 aa, Homo sapiens; identical to SEQ ID NO: 803067

SEQ ID NO: 803070 - protein, 221 aa, Homo sapiens; identical to SEQ ID NO: 803067

SEQ ID NO: 803071 - protein, 235 aa, Homo sapiens
MASSTSLPAPGSRPKKPLGKMADWFRQTLLKKPKKRPNSPESTSSDASQPTSQDSPLPPSLSSVTSPSLPPTHASDSGSSRWSKDYDVCVCHSEEDLVAAQDLVSYLEGSTASLRCFLQLRDATPGGAIVSELCQALSSSHCRVLLITPGFLQDPWCKYQMLQALTEAPGAEGCTIPLLSGLSRAAYPPELRFMYYVDGRGPDGGFRQVKEAVMRCKLLQEGEGERDSATVSDLL

SEQ ID NO: 803072 - protein, 221 aa, Homo sapiens; identical to SEQ ID NO: 803067

SEQ ID NO: 803073 - protein, 102 aa, Homo sapiens
MGERVRIKFGDFDIEDSDSCHFNYLRIYNGIGVSRTEIGKYCGLGLQMNHSIESKGNEITLLFMSGIHVSGRGFLASYSVIDKQGNFHLLQWFLQFVISNNK

SEQ ID NO: 803074 - protein, 605 aa, Homo sapiens
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGNSRGLCISFLSEGCRSPTGGSSEKRVILWPR

SEQ ID NO: 803075 - protein, 686 aa, Homo sapiens
MPLVRGVRSPRAMTGFVHARPRPGSKSGKPRFLERGAARECAGVVEHGAAMSRECGAECAAECPGGGSCQSWIRRSRSAPVTRACSSPGPSRSSEAREELRRHLVGLIERSRVVIFSKSYCPHSTRVKELFSSLGVECNVLELDQVDDGARVQEVLSEITNQKTVPNIFVNKVHVGGCDQTFQAYQSGLLQKLLQEDLAYDYDLIIIGGGSGGLSCAKEAAILGKKVMVLDFVVPSPQGTSWGLGGTCVNVGCIPKKLMHQAALLGQALCDSRKFGWEYNQQVRHNWETMTKAIQNHISSLNWGYRLSLREKAVAYVNSYGEFVEHHKIKATNKKGQETYYTAAQFVIATGERPRYLGIQGDKEYCITSDDLFSLPYCPGKTLVVGASYVALECAGFLAGFGLDVTVMVRSILLRGFDQEMAEKVGSYMEQHGVKFLRKFIPVMVQQLEKGSPGKLKVLAKSTEGTETIEGVYNTVLLAIGRDSCTRKIGLEKIGVKINEKSGKIPVNDVEQTNVPYVYAVGDILEDKPELTPVAIQSGKLLAQRLFGASLEKCDYINVPTTVFTPLEYGCCGLSEEKAIEVYKKENLEIYHTLFWPLEWTVAGRENNTCYAKIICNKFDHDRVIGFHILGPNAGEVTQGFAAAMKCGLTKQLLDDTIGIHPTCGEVFTTLEITKSSGLDITQKGC

SEQ ID NO: 803076 - protein, 459 aa, Homo sapiens
MVLDFVVPSPQGTSWGLGGTCVNVGCIPKKLMHQAALLGQALCDSRKFGWEYNQQVRHNWETMTKAIQNHISSLNWGYRLSLREKAVAYVNSYGEFVEHHKIKATNKKGQETYYTAAQFVIATGERPRYLGIQGDKEYCITSDDLFSLPYCPGKTLVVGASYVALECAGFLAGFGLDVTVMVRSILLRGFDQEMAEKVGSYMEQHGVKFLRKFIPVMVQQLEKGSPGKLKVLAKSTEGTETIEGVYNTVLLAIGRDSCTRKIGLEKIGVKINEKSGKIPVNDVEQTNVPYVYAVGDILEDKPELTPVAIQSGKLLAQRLFGASLEKCDYINVPTTVFTPLEYGCCGLSEEKAIEVYKKENLEIYHTLFWPLEWTVAGRENNTCYAKIICNKFDHDRVIGFHILGPNAGEVTQGFAAAMKCGLTKQLLDDTIGIHPTCGEVFTTLEITKSSGLDITQKGC

SEQ ID NO: 803077 - protein, 436 aa, Homo sapiens
MSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGNSRGLCISFLSEGCRSPTGGSSEKRVILWPR

SEQ ID NO: 803078 - protein, 683 aa, Homo sapiens
ARVVRVASEGSVRRPSGPVPAPQPPAFRFVSRPGRARSESETLERSPPQSPGPGKAGDAPNRRSGHVRGARVLSPPGRRARLSSPGPSRSSEAREELRRHLVGLIERSRVVIFSKSYCPHSTRVKELFSSLGVECNVLELDQVDDGARVQEVLSEITNQKTVPNIFVNKVHVGGCDQTFQAYQSGLLQKLLQEDLAYDYDLIIIGGGSGGLSCAKEAAILGKKVMVLDFVVPSPQGTSWGLGGTCVNVGCIPKKLMHQAALLGQALCDSRKFGWEYNQQVRHNWETMTKAIQNHISSLNWGYRLSLREKAVAYVNSYGEFVEHHKIKATNKKGQETYYTAAQFVIATGERPRYLGIQGDKEYCITSDDLFSLPYCPGKTLVVGASYVALECAGFLAGFGLDVTVMVRSILLRGFDQEMAEKVGSYMEQHGVKFLRKFIPVMVQQLEKGSPGKLKVLAKSTEGTETIEGVYNTVLLAIGRDSCTRKIGLEKIGVKINEKSGKIPVNDVEQTNVPYVYAVGDILEDKPELTPVAIQSGKLLAQRLFGASLEKCDYINVPTTVFTPLEYGCCGLSEEKAIEVYKKENLEIYHTLFWPLEWTVAGRENNTCYAKIICNKFDHDRVIGFHILGPNAGEVTQGFAAAMKCGLTKQLLDDTIGIHPTCGEVFTTLEITKSSGLDITQKGC

SEQ ID NO: 803079 - protein, 683 aa, Homo sapiens; identical to SEQ ID NO: 803078

SEQ ID NO: 803080 - protein, 642 aa, Homo sapiens
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGWWKGMKQFLPAKAVDHEETPVRYSSSEVNHLSPREVTTVLQADSAEYAQPLVGGIVGTLHQRSTFKPE

SEQ ID NO: 803081 - protein, 513 aa, Homo sapiens
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIPKQVVKLEALQELNVAFNSLTDLPGCDSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCSYLDLPWY

SEQ ID NO: 803082 - protein, 1150 aa, Homo sapiens
MHPPETTTKMASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 803083 - protein, 1150 aa, Homo sapiens; identical to SEQ ID NO: 803082

SEQ ID NO: 803084 - protein, 1159 aa, Homo sapiens
ARWTRSPRAAAAGRGFRAPAGRFRPLTAPPGFSSQGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 803085 - protein, 463 aa, Homo sapiens [sequence omitted]

SEQ ID NO: 803086 - protein, 1025 aa, Homo sapiens
ARWTRSPRAAAAGRGFRAPAGRFRPLTAPPGFSSQGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMVRKLSLRYKRFIPPFLSLSSLNLFWFGKFFRSKCGLIP

SEQ ID NO: 803087 - protein, 1116 aa, Homo sapiens
LEGSLNTERAKYYLTITMPHFTVTKVEDPEEGAAASISQEPSLADIKARIQDSDEPDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 803088 - protein, 1116 aa, Homo sapiens; identical to SEQ ID NO: 803087

SEQ ID NO: 803089 - protein, 1088 aa, Homo sapiens
MSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 803090 - protein, 112 aa, Homo sapiens
SLLDLSPYFFSLRVCMLGNRTLSSRHIDVCSKTKEINNMTVPSKLWGFFCNSSQFFNATCDEYFVHNNVTSIQGIPGLASGIITGKLGSYWTSFFLFFGENRPCHLRFLYCP

SEQ ID NO: 803091 - protein, 181 aa, Homo sapiens
KAAAAASAAGPGGLVAGKEEKKKAGGGVLNRLKARRQAPHHAADDGVGAAVTEQELLALDTIRPEHVLRLSRVTENYLCKPEDNIYSIDFTRFKIRDLETGTVLFEIAKPCVSDQEEDEEEGGGDVDISAGRFVRYQFTPAFLRLRTVGATVEFTVGDKPVSNFRMIERHYFREHLLKNFD

SEQ ID NO: 803092 - protein, 122 aa, Homo sapiens
AAAPTPASGTLTAGRFALLGIAVAAVVAGPEALVFHHRRHGRREGPLGPTTPLGARGRPRRSAGARGGRGGERSLARGPVGGDGGRVPKPCVWAGASHSCALSAPFHSLLKQRRTTINSIKK

SEQ ID NO: 803093 - protein, 122 aa, Homo sapiens
MEDTPLVISKQKTEVVCGVPTQVVCTAFSSHILVVVTQFGKMGTLVSLEPSSVASDVSKPVLTTKVLLGQDEPLIHVFAKNLVAFVSQEAGNRAVLLAVAVKDKSMEGLKALREVIRVCQVW

SEQ ID NO: 803094 - protein, 122 aa, Homo sapiens; identical to SEQ ID NO: 803093

SEQ ID NO: 803095 - protein, 115 aa, Homo sapiens
GTAFSSHILGGVPTQVVCTAFSSHILVVVTQFGKMGTLVSLEPSSVASDVSKPVLTTKVLLGQDEPLIHVFAKNLVAFVSQEAGNRAVLLAVAVKDKSMEGLKALREVIRVCQVW

SEQ ID NO: 803096 - protein, 122 aa, Homo sapiens; identical to SEQ ID NO: 803093

SEQ ID NO: 803097 - protein, 88 aa, Homo sapiens
YPRASPGGCVPSSPAGLGTACRGGPGPRLQGRGGGEAEGREATARPGSVNVQVDPLTQKAPGAVSMGGPAPASVLFFYGQGLALPPGL

SEQ ID NO: 803098 - protein, 122 aa, Homo sapiens; identical to SEQ ID NO: 803093

SEQ ID NO: 803099 - protein, 122 aa, Homo sapiens; identical to SEQ ID NO: 803093

SEQ ID NO: 803100 - protein, 238 aa, Homo sapiens
MAADGQCSLPASWRPVTLTHVEYPAGDLSGHLLAYLSLSPVFVIVGFVTLIIFKRELHTISFLGGLALNEGVNWLIKNVIQEPRPCGGPHTAVGTKYGMPSSHSQFMWFFSVYSFLFLYLRMHQTNNARFLDLLWRHVLSLGLLAVAFLVSYSRVYLLYHTWSQVLYGGIAGGLMAIAWFIFTQEVLTPLFPRIAAWPVSEFFLIRDTSLIPNVLWFEYTVTRAEARNRQRKLGTKLQ

SEQ ID NO: 803101 - protein, 195 aa, Homo sapiens
MAADGQCSLPASWRPVTLTHVEYPAGDLSGHLLAYLSLSPVFVIVGFVTLIIFKRELHTISFLGGLALNEGVNWLIKNVIQEPRPCGGPHTAVGTKYGMPSSHSQFMWFFSVYSFLFLYLRMHQTNNARFLDLLWRHVLSLGLLAVAFLVSYSRPVSEFFLIRDTSLIPNVLWFEYTVTRAEARNRQRKLGTKLQ

SEQ ID NO: 803102 - protein, 238 aa, Homo sapiens; identical to SEQ ID NO: 803100

SEQ ID NO: 803103 - protein, 175 aa, Homo sapiens
MNKVDQRAEPAPQPGPWGACCLGAVARDPRCAAASPWLGRKCPRHGHLGVGWRRRARASGLGARNSRWREKYTLFIFWFCQRQAGFWSWKNLLSGGCPVNRGLPVSFPGPSPYAQRADCLSLGRGGLGARRRGAYPTPSLPPLPFQNLGQCFPVWGQGPERARVWRLLSLCSTPY

SEQ ID NO: 803104 - protein, 238 aa, Homo sapiens; identical to SEQ ID NO: 803100

SEQ ID NO: 803105 - protein, 238 aa, Homo sapiens; identical to SEQ ID NO: 803100

SEQ ID NO: 803106 - protein, 175 aa, Homo sapiens; identical to SEQ ID NO: 803103

SEQ ID NO: 803107 - protein, 342 aa, Homo sapiens [sequence omitted]

SEQ ID NO: 803108 - protein, 342 aa, Homo sapiens [sequence omitted]

SEQ ID NO: 803109 - protein, 131 aa, Homo sapiens
MSSSGTLSNYYVDSLIGHEGDEVFAARFGPPGPGAQGRPAGVADGPAATAAEFASCSFAPRSAVFSASVGGRGGGPPGSCPRTSCKCYCFLLINADLIKWSPDAGPKHCVPAFSASLQNITLRIFLLYPWE

SEQ ID NO: 803110 - protein, 342 aa, Homo sapiens [sequence omitted]

SEQ ID NO: 803111 - protein, 342 aa, Homo sapiens [sequence omitted]

SEQ ID NO: 803112 - protein, 1003 aa, Homo sapiens
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 803113 - protein, 1003 aa, Homo sapiens; identical to SEQ ID NO: 803112

SEQ ID NO: 803114 - protein, 1003 aa, Homo sapiens; identical to SEQ ID NO: 803112

SEQ ID NO: 803115 - protein, 221 aa, Homo sapiens
SISGMVRGWVVPACYMSLQQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 803116 - protein, 587 aa, Homo sapiens
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGERSLSLYPQRLSPSQRLRLVC

SEQ ID NO: 803117 - protein, 175 aa, Homo sapiens
RYPMPSSSGKESSKSMTVKSLTGQFPEFYYVPPIPFSPMESLRARPTLFQKPYKLEVDNINVNFMGKPLYVKHEPLRTHQNIRHHNNRCSNCKPGQQVDDFTLWTVFPKMSEQDSPLDEGMHALIQWGAALRSSLVPSDLGSPPAPHASSSPPSDPPLFHWMQVMGILLDHLSIS

SEQ ID NO: 803118 - protein, 917 aa, Homo sapiens
EFTSDGAEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 803119 - protein, 1003 aa, Homo sapiens; identical to SEQ ID NO: 803112

SEQ ID NO: 803120 - protein, 1003 aa, Homo sapiens; identical to SEQ ID NO: 803112

SEQ ID NO: 803121 - protein, 266 aa, Homo sapiens
TPDYNFSTGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 803122 - protein, 106 aa, Homo sapiens
MEGGLALHMPKNWARLSWSQGAEVLTLWSLGTGLGKDGCRLSQQIPEIFIGACLTLLRIFLLRGCWAVLLFRVGQTPDSPISLLALQVWAKLVAPALDWTPQCLQR

SEQ ID NO: 803123 - protein, 541 aa, Homo sapiens
DLDFPELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSVFLPLVSATEASDYPAVSELSIEKPRTASTETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQQKEEKTKQEAYAQNRARAKEFHKKTLEKLRAKNTC

SEQ ID NO: 803124 - protein, 571 aa, Homo sapiens
DLDFPELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSVFLPLVSATEASDYPAVSELSIEKPRTASTETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQQKEEKTKQEAYAQNRARAKEFHKVSITEGEGLNFSSMKYTTETQIFIPSTENTRETSSQKYMLTF

SEQ ID NO: 803125 - protein, 125 aa, Homo sapiens [sequence omitted]

SEQ ID NO: 803126 - protein, 200 aa, Homo sapiens
MEKLGPQLSSGAWNQGPLPSRDPNAPVLPGPPGSPNSPTYLGRRHHPERRDLGLGAWVARIVRGWRERGRGVGPGRLGWPSIPPPCSPHSPIPRTAEQGEAGLEAIAGALQPQLVVHLCVDVLQRWQRRAVWVAVVPAHQGQAPQEQALVDLGTEAQLSGHRGLNGSSELMWLASPERIPAVYQAWGHSDDQDRPCPHRH

SEQ ID NO: 803127 - protein, 552 aa, Homo sapiens
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 803128 - protein, 161 aa, Homo sapiens
PVWVTERDFLSKKKKKRPGAVAYACNPSTLGAQGGQITRSQAGLEVLTSVIHSPQPKCCDYRPEPLRPALILRFPGRRWLKAETLMPWASHWIPVLCFTPSYQKGGIWMSGGPSGKAQIPGDFPERLDPPKSAPRPRSPSFSSGTQRPTPQMGELVTSSGP

SEQ ID NO: 803129 - protein, 661 aa, Homo sapiens
MEGAAAPVAGDRPDLGLGAPGSPREAVAGATAALEPRKPHGVKRHHHKHNLKHRYELQETLGKGTYGKVKRATERFSGRVVAIKSIRKDKIKDEQDMVHIRREIEIMSSLNHPHIISIYEVFENKDKIVIIMEYASKGELYDYISERRRLSERETRHFFRQIVSAVHYCHKNGVVHRDLKLENILLDDNCNIKIADFGLSNLYQKDKFLQTFCGSPLYASPEIVNGRPYRGPEVDSWALGVLLYTLVYGTMPFDGFDHKNLIRQISSGEYREPTQPSDARGLIRWMLMVNPDRRATIEDIANHWWVNWGYKSSVCDCDALHDSESPLLARIIDWHHRSTGLQADTEAKMKGLAKPTTSEVMLERQRSLKKSKKENDFAQSGQDAVPESPSKLSSKRPKGILKKRSNSEHRSHSTGFIEGVVGPALPSTFKMEQDLCRTGVLLPSSPEAEVPGKLSPKQSATMPKKGILKKTQQRESGYYSSPERSESSELLDSNDVMGSSIPSPSPPDPARVTSHSLSCRRKGILKHSSKYSAGTMDPALVSPEMPTLESLSEPGVPAEGLSRSYSRPSSVISDDSVLSSDSFDLLDLQENRPARQRIRSCVSAENFLQIQDFEGLQNRPRPQYLKRYRNRLADSSFSLLTDMDDVTQVYKQALEICSKLN

SEQ ID NO: 803130 - protein, 198 aa, Homo sapiens
MEGAAAPVAGDRPDLGLGAPGSPREAVAGATAALEPRKPHGVKRHHHKHNLKHRYELQETLGKGTYGKVKRATERFSGRVVAIKSIRKDKIKDEQDMVHIRREIEIMSSLNHPHIISIYEVFENKDKIVIIMEYASKGELYDYISERRRLSERETRHFFRQIVSAVHYCHKNGVVHRDLKLENIPAERIRLLLFPRAQ

SEQ ID NO: 803131 - protein, 565 aa, Homo sapiens
MVHIRREIEIMSSLNHPHIISIYEVFENKDKIVIIMEYASKGELYDYISERRRLSERETRHFFRQIVSAVHYCHKNGVVHRDLKLENILLDDNCNIKIADFGLSNLYQKDKFLQTFCGSPLYASPEIVNGRPYRGPEVDSWALGVLLYTLVYGTMPFDGFDHKNLIRQISSGEYREPTQPSDARGLIRWMLMVNPDRRATIEDIANHWWVNWGYKSSVCDCDALHDSESPLLARIIDWHHRSTGLQADTEAKMKGLAKPTTSEVMLERQRSLKKSKKENDFAQSGQDAVPESPSKLSSKRPKGILKKRSNSEHRSHSTGFIEGVVGPALPSTFKMEQDLCRTGVLLPSSPEAEVPGKLSPKQSATMPKKGILKKTQQRESGYYSSPERSESSELLDSNDVMGSSIPSPSPPDPARVTSHSLSCRRKGILKHSSKYSAGTMDPALVSPEMPTLESLSEPGVPAEGLSRSYSRPSSVISDDSVLSSDSFDLLDLQENRPARQRIRSCVSAENFLQIQDFEGLQNRPRPQYLKRYRNRLADSSFSLLTDMDDVTQVYKQALEICSKLN

SEQ ID NO: 803132 - protein, 197 aa, Homo sapiens
MVHIRREIEIMSSLNHPHIISIYEVFENKDKIVIIMEYASKGELYDYISERRRLSERETRHFFRQIVSAVHYCHKNGVVHRDLKLENILLDDNCNIKIADFGLSNLYQKDKFLQTFCGSPLYASPEIVNGRPYRGPEVDSWALGVLLYTLVYGTMPFDGFDHKNLIRQISSGEYREPTQPSDPPESSWKERCIIEQD

SEQ ID NO: 803133 - protein, 565 aa, Homo sapiens; identical to SEQ ID NO: 803131

SEQ ID NO: 803134 - protein, 565 aa, Homo sapiens; identical to SEQ ID NO: 803131

SEQ ID NO: 803135 - protein, 334 aa, Homo sapiens
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 803136 - protein, 449 aa, Homo sapiens
LTAEKQVSQVPGRSVTQARYSQPHLILFPWHPPAQCDIVTLNPSVFSNARQIPFRQDNCDISVPDCKYLLSLKLLLLAIVSFSFFICKMGIIQSILATSRDCYSFKKKPIPKKPTMLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 803137 - protein, 357 aa, Homo sapiens
LTAEKQVSQVPGRSVTQARYSQPHLILFPWHPPAQCDIVTLNPSVFSNARQIPFRQDNCDISVPDCKYLLSLKLLLLAIVSFSFFICKMGIIQSILATSRDCYSFKKKPIPKKPTMLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKGSAIRQCTGTL

SEQ ID NO: 803138 - protein, 144 aa, Homo sapiens
MSLDLSLALRANLVTLEGIVTQPPPSAGPSPGLQARWFVTLHLCLHKEDSCRLVGLGSPTQVVLPHLLRSQAAPGQEHKGGLVGDQPLRGTCGATAASAHSSPPTFPRPRIMYPSLLTGHRTRHWLGQHWSHFGRCPTAGAGSG

SEQ ID NO: 803139 - protein, 214 aa, Homo sapiens
MAWASGFLCSLAGRFSRSPGCGQAVGVAGGPKPPLHVGQGSLGEIRPDVAQQRQPVGKAPPGLGDHLSQDADAGGDHLSLDADAGVVPAGRSGAEGPDADPVLPVEVGDLAVLLDLGAEEGPGLQNPVLLGGAQLSGKRLGPSSRHWAARSFRNLRSRPEIKCQGSVTSDGWHQNVGKCTRRRVPGTVCPPTVAWGRRPRPGHSFAARSCRRGK

SEQ ID NO: 803140 - protein, 1838 aa, Homo sapiens
RRKPNEFLGGCRMGDSKVKVAVRIRPMNRRETDLHTKCVVDVDANKVILNPVNTNLSKGDARGQPKVFAYDHCFWSMDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKDSLGGNSKTAMVATVSPAADNYDETLSTLRYADRAKHIVNHAVVNEDPNARIIRDLREEVEKLREQLTKAEAMKSPELKDRLEESEKLIQEMTVTWEEKLRKTEEIAQERQKQLESLGISLQSSGIKVGDDKCFLVNLNADPALNELLVYYLKEHTLIGSANSQDIQLCGMGILPEHCIIDITSEGQVMLTPQKNTRTFVNGSSVSSPIQLHHGDRILWGNNHFFRLNLPKKKKKAEREDEDQDPSMKNENSSEQLDVDGDSSSEVSSEVNFNYEYAQMEVTMKALGSNDPMQSILNSLEQQHEEEKRSALERQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKRGSLLSEPAIQVRRKGKGKQIWSLEKLDNRLLDMRDLYQEWKECEEDNPVIRSYFKRADPFYDEQENLSLIGVANVFLESLFYDVKLQYAVPIINQKGEVAGRLHVEVMRLSGDVGERIAGGDEVAEVPFEKETQENKLVCMVKILQATGLPQHLSHFVFCKYSFWDQQEPVIVAPEVDTSSSSVSKEPHCMVVFDHCNEFSVNITEDFIEHLSEGALAIEVYGHKINDPRKNPALWDLGIIQAKTRSLRDRWSEVTRKLEFWVQILEQNENGEYCPVEVISAKDVPTGGIFQLRQGQSRRVQVEVKSVQESGTLPLMEECILSVGIGCVKVRPLRAPRTHETFHEEEEDMDSYQDRDLERLRRKWLNALTKRQEYLDQQLQKLVSKRDKTEDDADREAQLLEMRLTLTEERNAVMVPSAGSGIPGAPAEWTPVPGMETHIPVIFLDLNADDFSSQDNLDDPEAGGWDATLTGEEEEEFFELQIVKQHDGEVKAEASWDSAVHGCPQLSRGTPVDERLFLIVRVTVQLSHPADMQLVLRKRICVNVHGRQGFAQSLLKKMSHRSSIPGCGVTFEIVSNIPEDAQGVEEREALARMAANVENPASADSEAYIEKYLRSVLAVENLLTLDRLRQEVAVKEQLTGKGKLSRRSISSPNVNRLSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQPVPRIMVQSASPDIRVTRMEEAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 803141 - protein, 1501 aa, Homo sapiens
MVATVSPAADNYDETLSTLRYADRAKHIVNHAVVNEDPNARIIRDLREEVEKLREQLTKAEAMKSPELKDRLEESEKLIQEMTVTWEEKLRKTEEIAQERQKQLESLGISLQSSGIKVGDDKCFLVNLNADPALNELLVYYLKEHTLIGSANSQDIQLCGMGILPEHCIIDITSEGQVMLTPQKNTRTFVNGSSVSSPIQLHHGDRILWGNNHFFRLNLPKKKKKAEREDEDQDPSMKNENSSEQLDVDGDSSSEVSSEVNFNYEYAQMEVTMKALGSNDPMQSILNSLEQQHEEEKRSALERQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKRGSLLSEPAIQVRRKGKGKQIWSLEKLDNRLLDMRDLYQEWKECEEDNPVIRSYFKRADPFYDEQENLSLIGVANVFLESLFYDVKLQYAVPIINQKGEVAGRLHVEVMRLSGDVGERIAGGDEVAEVPFEKETQENKLVCMVKILQATGLPQHLSHFVFCKYSFWDQQEPVIVAPEVDTSSSSVSKEPHCMVVFDHCNEFSVNITEDFIEHLSEGALAIEVYGHKINDPRKNPALWDLGIIQAKTRSLRDRWSEVTRKLEFWVQILEQNENGEYCPVEVISAKDVPTGGIFQLRQGQSRRVQVEVKSVQESGTLPLMEECILSVGIGCVKVRPLRAPRTHETFHEEEEDMDSYQDRDLERLRRKWLNALTKRQEYLDQQLQKLVSKRDKTEDDADREAQLLEMRLTLTEERNAVMVPSAGSGIPGAPAEWTPVPGMETHIPVIFLDLNADDFSSQDNLDDPEAGGWDATLTGEEEEEFFELQIVKQHDGEVKAEASWDSAVHGCPQLSRGTPVDERLFLIVRVTVQLSHPADMQLVLRKRICVNVHGRQGFAQSLLKKMSHRSSIPGCGVTFEIVSNIPEDAQGVEEREALARMAANVENPASADSEAYIEKYLRSVLAVENLLTLDRLRQEVAVKEQLTGKGKLSRRSISSPNVNRLSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQPVPRIMVQSASPDIRVTRMEEAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 803142 - protein, 1838 aa, Homo sapiens; identical to SEQ ID NO: 803140

SEQ ID NO: 803143 - protein, 366 aa, Homo sapiens [sequence omitted]

SEQ ID NO: 803144 - protein, 1838 aa, Homo sapiens; identical to SEQ ID NO: 803140

SEQ ID NO: 803145 - protein, 1838 aa, Homo sapiens; identical to SEQ ID NO: 803140

SEQ ID NO: 803146 - protein, 369 aa, Homo sapiens
RRKPNEFLGGCRMGDSKVKVAVRIRPMNRRETDLHTKCVVDVDANKVILNPVNTNLSKGDARGQPKVFAYDHCFWSMDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKVSLFFFPSWHTFGGWQEGRKKSRLLIPFPGIISSIGVQMYNY

SEQ ID NO: 803147 - protein, 1762 aa, Homo sapiens
MDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKDSLGGNSKTAMVATVSPAADNYDETLSTLRYADRAKHIVNHAVVNEDPNARIIRDLREEVEKLREQLTKAEAMKSPELKDRLEESEKLIQEMTVTWEEKLRKTEEIAQERQKQLESLGISLQSSGIKVGDDKCFLVNLNADPALNELLVYYLKEHTLIGSANSQDIQLCGMGILPEHCIIDITSEGQVMLTPQKNTRTFVNGSSVSSPIQLHHGDRILWGNNHFFRLNLPKKKKKAEREDEDQDPSMKNENSSEQLDVDGDSSSEVSSEVNFNYEYAQMEVTMKALGSNDPMQSILNSLEQQHEEEKRSALERQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKRGSLLSEPAIQVRRKGKGKQIWSLEKLDNRLLDMRDLYQEWKECEEDNPVIRSYFKRADPFYDEQENLSLIGVANVFLESLFYDVKLQYAVPIINQKGEVAGRLHVEVMRLSGDVGERIAGGDEVAEVPFEKETQENKLVCMVKILQATGLPQHLSHFVFCKYSFWDQQEPVIVAPEVDTSSSSVSKEPHCMVVFDHCNEFSVNITEDFIEHLSEGALAIEVYGHKINDPRKNPALWDLGIIQAKTRSLRDRWSEVTRKLEFWVQILEQNENGEYCPVEVISAKDVPTGGIFQLRQGQSRRVQVEVKSVQESGTLPLMEECILSVGIGCVKVRPLRAPRTHETFHEEEEDMDSYQDRDLERLRRKWLNALTKRQEYLDQQLQKLVSKRDKTEDDADREAQLLEMRLTLTEERNAVMVPSAGSGIPGAPAEWTPVPGMETHIPVIFLDLNADDFSSQDNLDDPEAGGWDATLTGEEEEEFFELQIVKQHDGEVKAEASWDSAVHGCPQLSRGTPVDERLFLIVRVTVQLSHPADMQLVLRKRICVNVHGRQGFAQSLLKKMSHRSSIPGCGVTFEIVSNIPEDAQGVEEREALARMAANVENPASADSEAYIEKYLRSVLAVENLLTLDRLRQEVAVKEQLTGKGKLSRRSISSPNVNRLSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQPVPRIMVQSASPDIRVTRMEEAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 803148 - protein, 710 aa, Homo sapiens
DSRVIHLLALYAQLLEMRLTLTEECNAVMVPSAGSGIPVAPAECPPVPGMETHIPVIFLDLNADDFSSQDNLDDPEAGGWDATLTGEEEEEFFELQIVKQHDGEVKAEASWDSAVHGCPQLSRGTPVDERLFLIVRVTVQLSHPADMQLVLRKRICVNVHGRQGFAQSLLKKMSHRSSIPGCGVTFEIVSNIPEDAQGVEEREALARMAANVENPASADSEAYIEKYLRSVLAVENLLTLDRLRQEVAVKEQLTGKGKLSRRSISSPNVNRLSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQPVPRIMVQSASPDIRVTRMEEAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 803149 - protein, 1838 aa, Homo sapiens; identical to SEQ ID NO: 803140

SEQ ID NO: 803150 - protein, 1838 aa, Homo sapiens; identical to SEQ ID NO: 803140

SEQ ID NO: 803151 - protein, 461 aa, Homo sapiens
RRKPNEFLGGCRMGDSKVKVAVRIRPMNRRETDLHTKCVVDVDANKVILNPVNTNLSKGDARGQPKVFAYDHCFWSMDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKDSLGGNSKTAMVATVSPAADNYDETLSTLRYADRAKHIVNHAVVNEDPNARIIRDLREEVEKLREQLTKAEAMKSPELKDRLEESEKLIQEMTVTWEEKLRKTEEIAQDDQNSSRVLEYLFSLRSFDDPPEYLT

SEQ ID NO: 803152 - protein, 71 aa, Homo sapiens
RRQGPRGRRGGGATRSRKPRRGPRGVGKRSPRPQPQRAWAASGAAPGECVRGASGCRVTCFGRGHSPEEHA

SEQ ID NO: 803153 - protein, 206 aa, Homo sapiens [sequence omitted]

SEQ ID NO: 803154 - protein, 206 aa, Homo sapiens [sequence omitted]

SEQ ID NO: 803155 - protein, 121 aa, Homo sapiens [sequence omitted]

SEQ ID NO: 803156 - protein, 207 aa, Homo sapiens
MKSSGHREWGVGKPGTPGDRAREGGSGPDPAPARGASSGAALRGQNVAVAETRRGRPNATLGPSPLQRPRPVTCPRFASHPEAGARAEPAAMSGEPGQTSVAPPPEEVEPGSGVRIVVEYCEPCGFEATYLELASAVKEQYPGIEIESRLGGTGAFEIEINGQLVFSKLENGGFPYEKDVSIYSVGRTSWSPYPNSASSCHSTPLAH

SEQ ID NO: 803157 - protein, 121 aa, Homo sapiens [sequence omitted]

SEQ ID NO: 803158 - protein, 206 aa, Homo sapiens [sequence omitted]

SEQ ID NO: 803159 - protein, 132 aa, Homo sapiens
GNWILTPPPYALHDSSEIPGEPGQTSVAPPPEEVEPGSGVRIVVEYCEPCGFEATYLELASAVKEQYPGIEIESRLGGTGAFEIEINGQLVFSKLENGGFPYEKDLIEAIRRASNGETLEKITNSRPPCVIL

SEQ ID NO: 803160 - protein, 104 aa, Homo sapiens
GVYRRPSALRGSAVGGGVCEPCGFEATYLELASAVKEQYPGIEIESRLGGTGAFEIEINGQLVFSKLENGGFPYEKDLIEAIRRASNGETLEKITNSRPPCVIL

SEQ ID NO: 803161 - protein, 447 aa, Homo sapiens
MLLDAGPQYPAIGVTTFGASRHHSAGDVAERDVGLGINPFADGMGAFKLNPSSHELASAGQTAFTSQAPGYAAAAALGHHHHPGHVGSYSSAAFNSTRDFLFRNRGFGDAAAAASAQHSLFAASAGGFGGPHGHTDAAGHLLFPGLHEQAAGHASPNVVNGQMRLGFSGDMYPRPEQYGQVTSPRSEHYAAPQLHGYGPMNVNMAAHHGAGAFFRYMRQPIKQELICKWIEPEQLANPKKSCNKTFSTMHELVTHVTVEHVGGPEQSNHICFWEECPREGKPFKAKYKLVNHIRVHTGEKPFPCPFPGCGKVFARSENLKIHKRTHTGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 803162 - protein, 447 aa, Homo sapiens; identical to SEQ ID NO: 803161

SEQ ID NO: 803163 - protein, 74 aa, Homo sapiens
RVCLRKHMKVHESSSQGSQPSPAASSGYESSTPPTIVSPSTDNPTTSSLSPSSSAVHHTAGHSALSSNFNEWYV

SEQ ID NO: 803164 - protein, 447 aa, Homo sapiens; identical to SEQ ID NO: 803161

SEQ ID NO: 803165 - protein, 144 aa, Homo sapiens
MRCDRHKVNPFGADSRLQSQAPDSGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 803166 - protein, 103 aa, Homo sapiens
MLGIWTLLPLVLTSVARLSSKSVNAQVTDINSKGLELRKTVTTVETQNLEGLHHDGQFCHKPCPPDVNMESSRNAHSPATPSAKRKDPDLTWGGFVFFFCQFH

SEQ ID NO: 803167 - protein, 149 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHDVNMESSRNAHSPATPSAKRKDPDLTWGGFVFFFCQFH

SEQ ID NO: 803168 - protein, 149 aa, Homo sapiens; identical to SEQ ID NO: 803167

SEQ ID NO: 803169 - protein, 335 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 803170 - protein, 314 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 803171 - protein, 314 aa, Homo sapiens; identical to SEQ ID NO: 803170

SEQ ID NO: 803172 - protein, 132 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHDVNMESSRNAHSPATPSAKRK

SEQ ID NO: 803173 - protein, 220 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPMLT

SEQ ID NO: 803174 - protein, 392 aa, Homo sapiens
TRAPGSGGLLREALETGSRGLLGPSLRPGCSERWRTCFSWALMRSADPAGQAGQLRRSSETTALHVEVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 803175 - protein, 188 aa, Homo sapiens
RKGHVSEAPEAVAAGTMLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 803176 - protein, 188 aa, Homo sapiens; identical to SEQ ID NO: 803175

SEQ ID NO: 803177 - protein, 172 aa, Homo sapiens
MLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 803178 - protein, 188 aa, Homo sapiens; identical to SEQ ID NO: 803175

SEQ ID NO: 803179 - protein, 188 aa, Homo sapiens; identical to SEQ ID NO: 803175

SEQ ID NO: 803180 - protein, 153 aa, Homo sapiens
RKGHVSEAPEAVAAGTMLLPNILLTGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRFFKFFMKKPQHPTRKKSCISCPVINQKS

SEQ ID NO: 803181 - protein, 172 aa, Homo sapiens; identical to SEQ ID NO: 803177

SEQ ID NO: 803182 - protein, 170 aa, Homo sapiens
RKGHVSEAPEAVAAGTMLLPNILLTGTPGVGKTTLGKELASYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 803183 - protein, 173 aa, Homo sapiens
RKGHVSEAPEAVAAGTMLLPNILLTGTPGVGKTTLGKELASKSGLKYINVGDLAREEQLYDGYDEEYDCPILDEDRVVDELDNQMREGGVIVVFVLRTDTNVLYERLETRGYNEKKLTDNIQCEIFQVLYEEATASYKEEIVHQLPSNKPEELENNVDQILKWIEQWIKDHNS

SEQ ID NO: 803184 - protein, 230 aa, Homo sapiens
MRTGTLSVSFELRPQSARETYPFRGRTTTPSSLGGSRACAIRHRPPFVSSPGTQFGTAWRQRGLRGKLLPSAEPQKRWIGPRGAFPRPYLFPPCVMDTVLGGRSPHLERPPTVCRHPVGRRPEAIQLPGTALPRVAPLPSQSSRILGFLRSLDATRARCLGDRPRAPAPPLPAKGPAPPGRGLVPLCTSRLALWFRGGLGFGLRPAAAAAGPLRGGPESCVRHAWLPAFL

SEQ ID NO: 803185 - protein, 48 aa, Homo sapiens
MVLVITHPCHFSRVGSQWPREAEIREPRAGPPQPLFVSGQPCRLSPTE

SEQ ID NO: 803186 - protein, 48 aa, Homo sapiens; identical to SEQ ID NO: 803185

SEQ ID NO: 803187 - protein, 451 aa, Homo sapiens
MVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803188 - protein, 451 aa, Homo sapiens; identical to SEQ ID NO: 803187

SEQ ID NO: 803189 - protein, 449 aa, Homo sapiens
MSQRNGVRSLRNIFTEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803190 - protein, 603 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQLQTLVRRTRDESISATECRQLCTHVYVQRLSECAEVTGTYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803191 - protein, 539 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803192 - protein, 247 aa, Homo sapiens
MSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803193 - protein, 387 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLGC

SEQ ID NO: 803194 - protein, 215 aa, Homo sapiens [sequence omitted]

SEQ ID NO: 803195 - protein, 262 aa, Homo sapiens
MLHNFLLLRNSSLWEYDLEKVPRLEPPASLPGEGLVWGPPGESGAPSAVTVLSSSLRLSSTKRAVKAALADDFDTPRVVDAILGLAHHGNGQLRASLKEPEGPRSPAVFGAIISYFEQFFETVGISLANQQLQTLVRRTRDESISATECRQLCTHVYVQRLSECAEVTGTYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803196 - protein, 128 aa, Homo sapiens
MLHNFLLLRNSSLWEYDLEKVPRLEPPASLPGEGLVWGPPGESGAPSAVTVLSSSLRLSSTKRAVKAALADDFDTPRVVDAILGLAHHGNGQLRASLKVAQRTGGLAVLLPGAWVGSSGGFFSCRLGG

SEQ ID NO: 803197 - protein, 223 aa, Homo sapiens
MLHNFLLLRNSSLWEYDLEKVPRLEPPASLPGEGLVWGPPGESGAPSAVTVLSSSLRLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803198 - protein, 564 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803199 - protein, 258 aa, Homo sapiens
AVPARRSFDDMLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDEASMPVTYLPLWQVRPKYTQGRGDTW

SEQ ID NO: 803200 - protein, 134 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRITLYITAPTLVLTIVFLHMNPRPLPNPCQTSN

SEQ ID NO: 803201 - protein, 482 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQLANSRAQNQR

SEQ ID NO: 803202 - protein, 581 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEAMSQRNGVRSLRNIFTEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 803203 - protein, 564 aa, Homo sapiens; identical to SEQ ID NO: 803198

SEQ ID NO: 803204 - protein, 569 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDRTTTPMLLRVKAFVA

SEQ ID NO: 803205 - protein, 538 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKATLHGVVDELVRFRQKVRQFALAMPEATGDARRQQPDCPRHQHQGQKQYNIHVGTAGSKDKRPKISGLRMEHSHEPAHDKTHPCFSGSRLYVKASCRGC

SEQ ID NO: 803206 - protein, 386 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLS

SEQ ID NO: 803207 - protein, 398 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWER

SEQ ID NO: 803208 - protein, 388 aa, Homo sapiens
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSGEPSTRGVDSPPSSETVILTGLKTAKCRPENKQNLVE

SEQ ID NO: 803209 - protein, 142 aa, Homo sapiens
GTASVTISSSSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQLANSRAQNQR

SEQ ID NO: 803210 - protein, 101 aa, Homo sapiens
ALPVTFSRGEGRGGDSVRAAGVWTAGEAQTLLGVFGTWRQSLLGGTARPLGNAGERPASLKTRPGPNGPRDRNLRDHGTQQLPQLAPQPLTLRPRPTEQYK

SEQ ID NO: 803211 - protein, 505 aa, Homo sapiens
TGPPSCQRCIWLGPGPWRPLGPCAEPRRPGRPGLRHFRGPSAAGPGGATRPGGGEQRKGLNRRSLEPPPGRGLPPPQLGRAGLAAPCCRLRPLQGREGAGRAEMRRRLRLRRDALLTLLLGASLGLLLYAQRDGAAPTASAPRGRGRAAPRPTPGPRAFQLPDAGAAPPAYEGDTPAPPTPTGPFDFARYLRAKDQRRFPLLINQPHKCRGDGAPGGRPDLLIAVKSVAEDFERRQAVRQTWGAEGRVQGALVRRVFLLGVPRGAGSGGADEVGEGARTHWRALLRAESLAYADILLWAFDDTFFNLTLKEIHFLAWASAFCPDVRFVFKGDADVFVNVGNLLEFLAPRDPAQDLLAGDVIVHARPIRTRASKYYIPEAVYGLPAYPAYAGGGGFVLSGATLHRLAGACAQVELFPIDDVFLGMCLQRLRLTPEPHPAFRTFGIPQPSAAPHLSTFDPCFYRELVVVHGLSAADIWLMWRLLHGPHGPACAHPQPVAAGPFQWDS

SEQ ID NO: 803212 - protein, 75 aa, Homo sapiens
LPVSLPGPGSQSWAGAEAAGELATWVNFLSLQAAGPGGATRPGGGEQRKGLNRRSLEPPPGRGLPPPQLGRAGLA

SEQ ID NO: 803213 - protein, 190 aa, Homo sapiens
GIPARAPRPTYPAAPGKKMAGSVADSDAVVKLDDGHLNNSLSSPVQADVYFPRLIVPFCGHIKGGMRPGKKVLVMGIVDLNPESFAISLTCGDSEDPPADVAIELKAVFTDRQLLRNSCISGERGEEQSAIPYFPFIPDQPFRVEILCEHPRFRVFVDGHQLFDFYHRIQTLSAIDTIKINGDLQITKLG

SEQ ID NO: 803214 - protein, 190 aa, Homo sapiens; identical to SEQ ID NO: 803213

SEQ ID NO: 803215 - protein, 200 aa, Homo sapiens
GIPARAPRPTYPAAPGKKMAGSVADSDAVVKLDDGHLNNSLSSPVQADVYFPRLIVPFCGHIKGGMRPGKKVLVMGIVDLNPESFAISLTCGDSEDPPADVAIELKAVFTDRQLLRNSCISGERGEEQSAIPYFPFIPDQPFRLEFLLAPRFECCDDTLLIYIDSTYRMHLVMDLRYSLLINTYSMVRPTITWLRVLQLD

SEQ ID NO: 803216 - protein, 90 aa, Homo sapiens
MTLQTREATHPRPWHRKARAERTDGCCPGLGQEGAHANASCRISAFGWQKADKGRAKPHQEAKGGPRSLSFYFPRQRHSEACLEKSIPRL

SEQ ID NO: 803217 - protein, 267 aa, Homo sapiens
MGPPLAPRPAHVPGEAGPRRTRESRPGAVSFADVAVYFSPEEWECLRPAQRALYRDVMRETFGHLGALGFSVPKPAFISWVEGEVEAWSPEAQDPDGESSAAFSRGQGQEAGSRDGNEEKERLKKCPKQKEVAHEVAVKEWWPSVACPEFCNPRQSPMNPWLKDTLTRRLPHSCPDCGRNFSYPSLLASHQRVHSGERPFSCGQCQARFSQRRYLLQHQFIHTGEKPYPCPDCGRRFRQRGSLAIHRRAHTGEKPYACSDCKSRFTY

SEQ ID NO: 803218 - protein, 182 aa, Homo sapiens
TQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 803219 - protein, 182 aa, Homo sapiens; identical to SEQ ID NO: 803218

SEQ ID NO: 803220 - protein, 182 aa, Homo sapiens; identical to SEQ ID NO: 803218

SEQ ID NO: 803221 - protein, 96 aa, Homo sapiens
QLYLLLPMRTLTETGSHSVTQEYSGTIIAQRKLELLGLSDALASASQVPGTTAGKKQILEEAHLLHTAHRLEIDVVSFARSQRRVPKALSFNPHFN

SEQ ID NO: 803222 - protein, 168 aa, Homo sapiens
PPTHTDVPARVLVRARHLRSRDRAAGPYAVDQAERGARRPCQAVELVTETFDVVKRVQDDHVVATQAPFHGGSQSSTQCLLTGRIAVHRWVLCAQDSCVVHHVHRAALGSQRHAQLFSTPALAAVRQPAKHHERHPLRERPLATALRQLPGCTRLRPWDAVTCLRLKI

SEQ ID NO: 803223 - protein, 687 aa, Homo sapiens
MAGMKTASGDYIDSSWELRVFVGEEDPEAESVTLRVTGESHIGGVLLKIVEQINRKQDWVMTHLYLGRAKTQGTTQRRPRVGALWPFGPKENAPQTFGENQTLGTKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 803224 - protein, 699 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDVSEGWAGARAGQELGQGQGLRSIKLGYTVPLTPLAQEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 803225 - protein, 663 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 803226 - protein, 619 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFIFLSTRERARGEELDEDLFLQLTGGHEAF

SEQ ID NO: 803227 - protein, 169 aa, Homo sapiens
RRYLQDLSEQSWQPVTSMVPQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 803228 - protein, 751 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLLLTTLSQPLPSPHPQGLTAPHPLQAGTQLGISPAVTDFVQAKDLAGPDAVPSPRPGMGVGVPELMWCPLSLSEWLRLIPLTYLQSPSTQGRPDVATG

SEQ ID NO: 803229 - protein, 663 aa, Homo sapiens; identical to SEQ ID NO: 803225

SEQ ID NO: 803230 - protein, 462 aa, Homo sapiens
RAAPSSSPYECLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 803231 - protein, 337 aa, Homo sapiens
TIYERSRAGGVAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 803232 - protein, 152 aa, Homo sapiens
MVPQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 803233 - protein, 476 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWNGWLPLASAVQGRRQFTARGRQSGHMVPYLSS

SEQ ID NO: 803234 - protein, 895 aa, Homo sapiens
RHCGGRAPSLGAGTRGGAKRGPLPPRAPMYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTTAVPEPCGVSRAPEARPSPMSGSLAPLGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 803235 - protein, 850 aa, Homo sapiens
NSGASCGGPATLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQVRSLEPEGIAGWDARKRRSTLSLFTSPQLEELKQQLEQQEEELGRLRLGVVRLQGDLAGPGMEGVLQVSAEVSSPPGGDGLREKGSASDSGERGPEAEPESHAGPPAALGPRAPHQGSAGGGEALLELQGRLQEAQDTTEALRAQLGVQEVQLQGLQGALQQLQQETEQNCRRELQQMHGQLAGKGWGVGLMGGPGGWAFPSNRLPSPGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTTAVPEPCGVSRAPEARPSPMSGSLAPLGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 803236 - protein, 819 aa, Homo sapiens
RHCGGRAPSLGAGTRGGAKRGPLPPRAPMYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQISTRPEDLGETVCSLKFADRVGQVELGPARRRRVPRSSGTPSSLSTDTPLTGTPCTPTPSPGSPPCPSPDNGSGSALAPAEGLPL

SEQ ID NO: 803237 - protein, 848 aa, Homo sapiens
RHCGGRAPSLGAGTRGGAKRGPLPPRAPMYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTTAVPEPCGVSRAPEARPSPMSGSLAPLGTLHLVDLAGSERARKAGAAGPPRGDPDGARRLREAQTINRSLLALGGVMAALRAHRPHVPFRDSQLTRLLQPALGPGTTAVLLLQISTRPEDLGETVCSLKFADRVGQVELGPARRRRVPRSSGTPSSLSTDTPLTGTPCTPTPSPGSPPCPSPDNGSGSALAPAEGLPL

SEQ ID NO: 803238 - protein, 819 aa, Homo sapiens; identical to SEQ ID NO: 803236

SEQ ID NO: 803239 - protein, 819 aa, Homo sapiens; identical to SEQ ID NO: 803236

SEQ ID NO: 803240 - protein, 489 aa, Homo sapiens
RHCGGRAPSLGAGTRGGAKRGPLPPRAPMYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGKGWGVGLMGGPGGWAFPSNRLPSPGLRARMASLRQGCGDLRGLVSTFTQSCQGSLSEARGQVSWALGALSSGGPGTQLPEGQQGPPAGCPGRLPELKGNIRVLCRLRPGTSCFAAECRKNRHDRPG

SEQ ID NO: 803241 - protein, 389 aa, Homo sapiens
RHCGGRAPSLGAGTRGGAKRGPLPPRAPMYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQVRSLEPEGIAGWDARKRRSTLSLFTSPQLEELKQQLEQQEEELGRLRLGVVRLQGDLAGPGMEGVLQVSAEVSSPPGGDGLREKGSASDSGERGPEAEPESHAGPPAALGPRAPHQGSAGGGGGIARAPGPASGGPRHHRSPPSPGGHGAQGSMAQ

SEQ ID NO: 803242 - protein, 920 aa, Homo sapiens
RHCGGRAPSLGAGTRGGAKRGPLPPRAPMYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGKGWGVGLMGGPGGWAFPSNRLPSPGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTTAVPEPCGVSRAPEARPSPMSGSLAPLGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 803243 - protein, 421 aa, Homo sapiens
MLLLKRLLVSSANGVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTTAVPEPCGVSRAPEARPSPMSGSLAPLGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 803244 - protein, 866 aa, Homo sapiens
RHCGGRAPSLGAGTRGGAKRGPLPPRAPMYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 803245 - protein, 269 aa, Homo sapiens
DASPTRRIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQISTRPEDLGETVCSLKFADRVGQVELGPARRRRVPRSSGTPSSLSTDTPLTGTPCTPTPSPGSPPCPSPDNGSGSALAPAEGLPL

SEQ ID NO: 803246 - protein, 819 aa, Homo sapiens; identical to SEQ ID NO: 803236

SEQ ID NO: 803247 - protein, 85 aa, Homo sapiens
KRVQHLTLENEALKQSLSLMRDLLLHWGPGPPIRAPQVLCSRAAAVPAAWGSCTPGMQPQGPSLLRTSRDGLCRAAPSGRLMPMG

SEQ ID NO: 803248 - protein, 96 aa, Homo sapiens
CSEWGYGGPNRDGSGRGGSWVLTQVVGARPELGNLEPQGSRWNPQDLLIAQGAPSVSEVPRNKATGRIITPTDSTAIRTPARAKDPITAGALERVR

SEQ ID NO: 803249 - protein, 126 aa, Homo sapiens
LTWLQGEPTSQWPQRRSWQDWVMLGRGRCPQRSGGTEEPPPPNSCRHCSWRCWVPGPQERLQDVHSPASQLQAPAGQGRGGDIDEMCGAAVAAEMEDTLDVGASEPGDVALSAEFRTQGDPQPSSH

SEQ ID NO: 803250 - protein, 212 aa, Homo sapiens
GRSWRGWFGVGAVGSRQINMESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDKCTVAVPLAQDPALQPFCVCSLVKFICCYYTHRPSCLVVRKAGLPKHC

SEQ ID NO: 803251 - protein, 325 aa, Homo sapiens
GRSWRGWFGVGAVGSRQINMESIFHEKQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 803252 - protein, 391 aa, Homo sapiens
GRSWRGWFGVGAVGSRQINMESIFHEKQEGSLCAQHCLNNLLQGEYFSPVELSSIAHQLDEEERMRMAEGGVTSEDYRTFLQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQSPKQTGRCEAMWGRCSKKGLRRACKSNVVKGDLGLRAGPHLGRRNMRETKSVFLLRPPALYLFFLSFSRTKNSTRDGRDESPDRTAGTTAPEQTSTATQRRETGTRRSEPAHSEEPRREQGTPRARATRKRRGAQEEEGGGREGRDEERAREQRAGGEGDRGGEGRRASASTRREKTADQSRTDD

SEQ ID NO: 803253 - protein, 148 aa, Homo sapiens
GRSWRGWFGVGAVGSRQINMESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPILSYFTFVMSMSICPVAFLAPQC

SEQ ID NO: 803254 - protein, 273 aa, Homo sapiens
MTVVFSLFRNERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQKQQQQQQQQQQGDLSGQSSHPCERPATSSGALGSDLGDAMSEEDMLQAAVTMSLETVRNDLKTEGKK

SEQ ID NO: 803255 - protein, 402 aa, Homo sapiens
GRSWRGWFGVGAVGSRQINMESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQQQQQQQQQQQQKQQQQQQQQQQGDLSGQSSHPCERPATSSGALGSDLGDAMSEEDMLQAAVTMSLETVRNDLKTEGKK

SEQ ID NO: 803256 - protein, 257 aa, Homo sapiens
MTVVFSLFRNERSFICNYKEHWFTVRKLGKQTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQKQQQQQQQQQQGDLSGQSSHPCERPATSSGALGSDLGDAMSEEDMLQAAVTMSLETVRNDLKTEGKK

SEQ ID NO: 803257 - protein, 405 aa, Homo sapiens
GRSWRGWFGVGAVGSRQINMESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQQQQQQQQQQQQKQQQQQQQQQQGDLSGQSSHPCERPATSSGALGSDLGKACSPFIMFATFTLYLTYELHVIFALHYSSFPL

SEQ ID NO: 803258 - protein, 380 aa, Homo sapiens
GRSWRGWFGVGAVGSRQINMESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 803259 - protein, 335 aa, Homo sapiens
GRSWRGWFGVGAVGSRQINMESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKAAAKAATAAAAAAAGGPIRTEFTSM

SEQ ID NO: 803260 - protein, 390 aa, Homo sapiens
GRSWRGWFGVGAVGSRQINMESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQKQQQQQQQQQQGDLSGQSSHPCERPATSSGALGSDLGDAMSEEDMLQAAVTMSLETVRNDLKTEGKK

SEQ ID NO: 803261 - protein, 356 aa, Homo sapiens
PSFTRNTRQEGSLCAQHCLNNLLQGEYFSPVELSSIAHQLDEEERMRMAEGGVTSEDYRTFLQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQKQQQQQQQQQQGDLSGQSSHPCERPATSSGALGSDLGDAMSEEDMLQAAVTMSLETVRNDLKTEGKK

SEQ ID NO: 803262 - protein, 212 aa, Homo sapiens; identical to SEQ ID NO: 803250

SEQ ID NO: 803263 - protein, 183 aa, Homo sapiens
RGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPNTQPVDVYMIFQEENPGVFYQYVISSPPPILE

SEQ ID NO: 803264 - protein, 76 aa, Homo sapiens
SYSPRLLQSQATLRHRVPGFQRSPDPVCPTESGQSQRGSARPGGKVNPSRRLKPTGGRPPGPLGRLRQEDRVSPGD

SEQ ID NO: 803265 - protein, 173 aa, Homo sapiens
GWWDWAQVPTASSASARTFWSPPPDRDPGGPSPFFRRGVGASRTLGSSRPSGSPFTVQDLSCTLALTPCFPGLSMAGYQLWSPWTPLDESFQWLRHTTPTPSSKHPFKASPCFPHTPSDLEVQLCFQEVTLVLDSPFLESGRWSFTTLPKLVLNSWTQAMPWPRPPKVLGLQR

SEQ ID NO: 803266 - protein, 251 aa, Homo sapiens
GWWDWAQVPTASSASARTFWSPPPDRDPGGPSPFFRRGVGASRTLGSSRPSGSPFTVQDLSCTLALTPCFPGLSMAGYQLWSPWTPLDESFQWLRHTTPTPSSKHPFKASPCFPHTPSDLEVQLCFQEVTLVLDSPFLESGVSPKLPCHTSELRTMNNKGLVRKPQPIRLSGVDSVFGRVITAQPPKWTGTFRVSDKSAFCKIISREHQWPIGLKEPQIQMTVTMCKQMLRSILLLYATYKKCTFALQHSK

SEQ ID NO: 803267 - protein, 70 aa, Homo sapiens
PSARHSPDPGVKSGICAVNIWPRSCPPRLGCPSQGKDMRRALSQSGRFCGCRHCGAWVCRRGRFSGGRDR

SEQ ID NO: 803268 - protein, 875 aa, Homo sapiens
MERAGPSFGQQRQQQQPQQQKQQQRDQDSVEAWLDDHWDFTFSYFVRKATREMVNAWFAERVHTIPVCKEGIRGHTESCSCPLQQSPRADNSVPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 803269 - protein, 948 aa, Homo sapiens
DKKSGAESAWRAGAPKPEELMHSRGAWTPGRAPLQKESVPRCRLLWAAAVGQRVLPLGREVTHAGSDGRGAARRFDCPRSHFAWRAGRGSCRVASPGGRRSAGRAGGDGRRRGGRGREGAGSESPTSPHLTCARCCPYGASWSPGSAEFENELPTFAMLPFGDKTREMVNAWFAERVHTIPVCKEGIRGHTESCSCPLQQSPRADNSVPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEVFI

SEQ ID NO: 803270 - protein, 612 aa, Homo sapiens
DKKSGAESAWRAGAPKPEELMHSRGAWTPGRAPLQKESVPRCRLLWAAAVGQRVLPLGREVTHAGSDGRGAARRFDCPRSHFAWRAGRGSCRVASPGGRRSAGRAGGDGRRRGGRGREGAGSESPTSPHLTCARCCPYGASWSPGSAEFENELPTFAMLPFGDKTREMVNAWFAERVHTIPVCKEGIRGHTESCSCPLQQSPRADNSVPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGKTFPLTYTLNLFLKMYSQLYFFLSNVKNKMF

SEQ ID NO: 803271 - protein, 643 aa, Homo sapiens
DKKSGAESAWRAGAPKPEELMHSRGAWTPGRAPLQKESVPRCRLLWAAAVGQRVLPLGREVTHAGSDGRGAARRFDCPRSHFAWRAGRGSCRVASPGGRRSAGRAGGDGRRRGGRGREGAGSESPTSPHLTCARCCPYGASWSPGSAEFENELPTFAMLPFGDKTREMVNAWFAERVHTIPVCKEGIRGHTESCSCPLQQSPRADNSVPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVGEV

SEQ ID NO: 803272 - protein, 875 aa, Homo sapiens; identical to SEQ ID NO: 803268

SEQ ID NO: 803273 - protein, 990 aa, Homo sapiens
DKKSGAESAWRAGAPKPEELMHSRGAWTPGRAPLQKESVPRCRLLWAAAVGQRVLPLGREVTHAGSDGRGAARRFDCPRSHFAWRAGRGSCRVASPGGRRSAGRAGGDGRRRGGRGREGAGSESPTSPHLTCARCCPYGASWSPGSAEFENELPTFAMLPFGDKTREMVNAWFAERVHTIPVCKEGIRGHTESCSCPLQQSPRADNSVPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 803274 - protein, 402 aa, Homo sapiens
MEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 803275 - protein, 172 aa, Homo sapiens
LNLTCAVASGPPRAHPCPGSAFPRCMLGSSPTCVGLYSDDFLLVILLAKLSLNILPKIFLLGAAAHACDANTLGGRGGRAAWGQKFKTSLGNLEPGPKTADPRTSHGVNCVGPVILTRLPMDFPPPLRQQDQPLSYLLLLLRLLNAKTTRRKTFMMIYLINSEYIFSSLGYS

SEQ ID NO: 803276 - protein, 180 aa, Homo sapiens
MMRHHTIYGRDDGGKGACLRGTVGTRQPGQPCPHPPGGQPCAESHLLFRKKISRPTRMRNRRMPTKAPAMTPVGRRHREPSERRSELLICLQPCPAFPLPQEPGPKTADPRTSHGVNCVGPVILTRLPMDFPPPLRQQDQPLSYLLLLLRLLNAKTTRRKTFMMIYLINSEYIFSSLGYS

SEQ ID NO: 803277 - protein, 116 aa, Homo sapiens
MTERPELQTSLGITSAERVLAMRLAEQVRMWGCPGTTSQKRRRGAEMWGCRRCPPATLLQGPKPQCNKARGPRDTAATLLLVTQVASDRATEGQLAALGFPCHFPLAGKWRQPDSL

SEQ ID NO: 803278 - protein, 391 aa, Homo sapiens
MDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQLTSKDHTPRVGTGQGRGQGTFWLSRDEGYFAEDTRIGHFQDSLPAPLPLPSFEALIKHKSGSPGAVCQRWAGGETEQRLRLSALCLVLDTRVPGPFLEAPLPPALPTGTSGSYNSAFMKLRSTLWSLCGLYPSLTRSSTYPCACAPIQPWGEGDDVFPALSCPRNPGSPLLLIAHTLEADKPEMALAKGASLSPGWPGAHPQFVWCFVSILLQFCPWT

SEQ ID NO: 803279 - protein, 993 aa, Homo sapiens
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQLTSKDHTPRVGTGQGRGQGTFWLSRDEGYFAEDTRIGHFQDSLPAPLPLPSFEALIKHKSGSPGAVCQRWAGGETEQRLRLSALCLVLDTRVPGPFLEAPLPPALPTGTSGSYNSAFMKLRSTLWSLCGLYPSLTRSSTYPCACAPIQPWGEGDDVFPALSCPRNPGSPLLLIAHTLEADKPEMALAKGASLSPGWPGAHPQFVWCFVSILLQFCPWT

SEQ ID NO: 803280 - protein, 149 aa, Homo sapiens
VVGEHPAILAAASWWRREPACLRVRVCAKFSGSTPRSPRRPPPPSLRPPSPQCLGTCWRQSQGCCMRGRRGDRMTINIQEHMAINVCPGPIRPIRQISDYFPRGPGPEGGGGGGGEGSEHVVAPWGLGPCLQAYPLVAQQRPEEWVARR

SEQ ID NO: 803281 - protein, 400 aa, Homo sapiens
MRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVGILRCAHLAAMDVNGYSDPYVKTYLRPDVDKKSKHKTCVKKKTLNPEFNEEFFYEIELSTLATKTLEVTVWDYDIGKSNDFIGGVSLGPGARGEARKHWSDCLQQPDAALERWHTLTSELPPAAGALSSA

SEQ ID NO: 803282 - protein, 400 aa, Homo sapiens; identical to SEQ ID NO: 803281

SEQ ID NO: 803283 - protein, 400 aa, Homo sapiens; identical to SEQ ID NO: 803281

SEQ ID NO: 803284 - protein, 400 aa, Homo sapiens; identical to SEQ ID NO: 803281

SEQ ID NO: 803285 - protein, 450 aa, Homo sapiens
SQWWAARVISPFVSSGCSTPRSPRRPPPPSLRPPSPQCLGTCWRQSQGCCMRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVGILRCAHLAAMDVNGYSDPYVKTYLRPDVDKKSKHKTCVKKKTLNPEFNEEFFYEIELSTLATKTLEVTVWDYDIGKSNDFIGGVSLGPGARGEARKHWSDCLQQPDAALERWHTLTSELPPAAGALSSA

SEQ ID NO: 803286 - protein, 465 aa, Homo sapiens
LLPQIVRLPSLARETPRSPAGDSRRPPAPVNLSTPRSPRRPPPPSLRPPSPQCLGTCWRQSQGCCMRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVGILRCAHLAAMDVNGYSDPYVKTYLRPDVDKKSKHKTCVKKKTLNPEFNEEFFYEIELSTLATKTLEVTVWDYDIGKSNDFIGGVSLGPGARGEARKHWSDCLQQPDAALERWHTLTSELPPAAGALSSA

SEQ ID NO: 803287 - protein, 69 aa, Homo sapiens
GLWYGPEFLGILDSALSSPAAAAQPAPAVPPVPGHLLEAEAGAGGWAGRGREGAGKRASLCALRGCSAL

SEQ ID NO: 803288 - protein, 400 aa, Homo sapiens; identical to SEQ ID NO: 803281

SEQ ID NO: 803289 - protein, 400 aa, Homo sapiens; identical to SEQ ID NO: 803281

SEQ ID NO: 803290 - protein, 448 aa, Homo sapiens
SPHFLGAPSLSARTASTPRSPRRPPPPSLRPPSPQCLGTCWRQSQGCCMRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVGILRCAHLAAMDVNGYSDPYVKTYLRPDVDKKSKHKTCVKKKTLNPEFNEEFFYEIELSTLATKTLEVTVWDYDIGKSNDFIGGVSLGPGARGEARKHWSDCLQQPDAALERWHTLTSELPPAAGALSSA

SEQ ID NO: 803291 - protein, 282 aa, Homo sapiens
MDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVGILRCAHLAAMDVNGYSDPYVKTYLRPDVDKKSKHKTCVKKKTLNPEFNEEFFYEIELSTLATKTLEVTVWDYDIGKSNDFIGGVSLGPGARGEARKHWSDCLQQPDAALERWHTLTSELPPAAGALSSA

SEQ ID NO: 803292 - protein, 98 aa, Homo sapiens
TQRDLGGDRGRACDGSGLSASAGLGKMLRPALPWLYLGLCSLLVGEAEAPSPVDPLERSRPYAVLRGQNLVLMGTIFSILLVTVILMAFCVYKPIRRR

SEQ ID NO: 803293 - protein, 113 aa, Homo sapiens
RRETWEETEAGLATEVASLLLQGWGRCCVQRYRGCTLASAASWWGRQRPRAPWIRWSGAGRTRCCEGRTWIKLFIEVLIRRDGCGVVCSSTFRGEVLLSQNSGESEMPNDVHK

SEQ ID NO: 803294 - protein, 98 aa, Homo sapiens; identical to SEQ ID NO: 803292

SEQ ID NO: 803295 - protein, 113 aa, Homo sapiens; identical to SEQ ID NO: 803293

SEQ ID NO: 803296 - protein, 102 aa, Homo sapiens
TQRDLGGDRGRACDGSGLSASAGLGKMLRPALPWLYLGLCSLLVGEAEAPSPVDPLERSRPYAVLRGQNLESLSPRLECNGAISARCNLRVWGSSDSPASAP

SEQ ID NO: 803297 - protein, 98 aa, Homo sapiens; identical to SEQ ID NO: 803292

SEQ ID NO: 803298 - protein, 319 aa, Homo sapiens
MGQGLWRVVRNQQLQQEGYSEQGYLTREQSRRMAASNISNTNHRKQVQGGIDIYHLLKARKSKEQEGFINLEMLPPELSFTILSYLNATDLCLASCVWQDLANDELLWQGLCKSTWGHCSIYNKNPPLGFSFRKLYMQLDEGSLTFNANPDEGVNYFMSKGILDDSPKEIAKFIFCTRTLNWKKLRIYLDERRDVLDDLVTLHNFRNQFLPNALREFFRHIHAPEERGEYLETLITKFSHRFCACNPDLMRELGLSPDAVYVLCYSLILLSIDLTSPHVKNKMSKREFIRNTRRAAQNISEDFVGHLYDNIYLIGHVAA

SEQ ID NO: 803299 - protein, 319 aa, Homo sapiens; identical to SEQ ID NO: 803298

SEQ ID NO: 803300 - protein, 358 aa, Homo sapiens
MGQGLWRVVRNQQLQQEGYSEQGYLTREQSRRMAASNISNTNHRKQVQGGIDIYHLLKARKSKEQEGFINLEMLPPELSFTILSYLNATDLCLASCVWQDLANDELLWQGLCKSTWGHCSIYNKNPPLGFSFRKLYMQLDEGSLTFNANPDEPQGTRFSKGHRSCHGYGYQAPQQLLAVAHGVGETSAQFVGVNYFMSKGILDDSPKEIAKFIFCTRTLNWKKLRIYLDERRDVLDDLVTLHNFRNQFLPNALREFFRHIHAPEERGEYLETLITKFSHRFCACNPDLMRELGLSPDAVYVLCYSLILLSIDLTSPHVKNKMSKREFIRNTRRAAQNISEDFVGHLYDNIYLIGHVAA

SEQ ID NO: 803301 - protein, 146 aa, Homo sapiens
MGQGLWRVVRNQQLQQEGYSEQGYLTREQSRRMAASNISNTNHRKQVQGGIDIYHLLKARKSKEQEGFINLEMLPPELSFTILSYLNATDLCLASCVWQDLANDELLWQGLCKSTWGHCSIYNKNPPLGFSFRKLYMQLDEGSLTE

SEQ ID NO: 803302 - protein, 319 aa, Homo sapiens; identical to SEQ ID NO: 803298

SEQ ID NO: 803303 - protein, 278 aa, Homo sapiens
MGQGLWRVVRNQQLQQEGYSEQGYLTREQSRRMAASNISNTNHRKQVQGGIDIYHLLKDLANDELLWQGLCKSTWGHCSIYNKNPPLGFSFRKLYMQLDEGSLTFNANPDEGVNYFMSKGILDDSPKEIAKFIFCTRTLNWKKLRIYLDERRDVLDDLVTLHNFRNQFLPNALREFFRHIHAPEERGEYLETLITKFSHRFCACNPDLMRELGLSPDAVYVLCYSLILLSIDLTSPHVKNKMSKREFIRNTRRAAQNISEDFVGHLYDNIYLIGHVAA

SEQ ID NO: 803304 - protein, 174 aa, Homo sapiens
GHSSPPGVSVRTAERGDLRPIPGAPCRLLGAHQAATSKEAGFKGPARQGEENGAYATIHSHQSPASRNQSLQPGACAQKRFSRRPFVFGIVGSCPPRTTARPSKLGASLCSRIPRCRFHTAFKTPVKSDSAESLLNGQSTSNLQLRSFSDLDGQSGSCYEVRNKESIANRKQQK

SEQ ID NO: 803305 - protein, 370 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYLKDPAAYPKIQMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 803306 - protein, 279 aa, Homo sapiens
MTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYLKDPAAYPKIQMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 803307 - protein, 145 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWECWHICSILFLTL

SEQ ID NO: 803308 - protein, 312 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYLKDPAAYPKIQMLAYMFYSVPYFVTALYGLVVPGCSWMPDITLIHAGGLAQPAAML

SEQ ID NO: 803309 - protein, 370 aa, Homo sapiens; identical to SEQ ID NO: 803305

SEQ ID NO: 803310 - protein, 175 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGYSRSPSERPAEKTI

SEQ ID NO: 803311 - protein, 188 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVDAGIYVLFCSLLCDCTVWLSGSWMFLDA

SEQ ID NO: 803312 - protein, 132 aa, Homo sapiens
PGTNVFILIVTTSLFWSLQFLDYCRGCCPHPVPGSTAGSCPRQKKTTPGPTVLWYVSTKGNLLYLINNTILSASVTYSSLVVNTLSPLVTVAASVGVFQDNLALASGYCLSGSGLHPLPGGIPVESYCQARQ

SEQ ID NO: 803313 - protein, 255 aa, Homo sapiens
MSASKWRGALATEGYPVLLPSHSVKPCTCSFPQITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 803314 - protein, 437 aa, Homo sapiens
MGLRAAPSSAAAAAAEVEQRRRPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 803315 - protein, 437 aa, Homo sapiens; identical to SEQ ID NO: 803314

SEQ ID NO: 803316 - protein, 563 aa, Homo sapiens
PGRRWVVARAGPASWRSTPAEPTLAGAGVPARSGLVSAVAHGLCVFSSAPFPACRLRPPRCPCAPLLPPRTGCAGCALLAAAVVAPHLLHGPEEGRRGSEARPPAHAAATGPDPPSPEPTRPAWTGMGLRAAPSSAAAAAAEVEQRRRPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 803317 - protein, 253 aa, Homo sapiens
MGLRAAPSSAAAAAAEVEQRRRPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKVMSWLPDGEICVKSNQHPAGYTNKHSTKPEWMPSPSLE

SEQ ID NO: 803318 - protein, 437 aa, Homo sapiens; identical to SEQ ID NO: 803314

SEQ ID NO: 803319 - protein, 437 aa, Homo sapiens; identical to SEQ ID NO: 803314

SEQ ID NO: 803320 - protein, 69 aa, Homo sapiens
LSSLPVLPRSSPDGVGSNVKAHRSMETHLNIAHCCFPRFGLPITRALHAYPSTSYYGSSDLDYYYWPIH

SEQ ID NO: 803321 - protein, 171 aa, Homo sapiens
MGLRAAPSSAAAAAAEVEQRRRPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGSSATATNKASIPSFFPLPTQLSKDV

SEQ ID NO: 803322 - protein, 277 aa, Homo sapiens
MANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKGRPMGGR

SEQ ID NO: 803323 - protein, 754 aa, Homo sapiens
MANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 803324 - protein, 547 aa, Homo sapiens
VRPRVFMAEGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 803325 - protein, 260 aa, Homo sapiens
GNGFCQLCENMAAAGLALLCRRVSSALKSSRSLITPQVPACTGFFLSLLPKSTPNVTSFHQYRLLHTTLSRKGLEEFFDDPKNWGQEKVKSGAAWTCQQLRNKSNEDLHKLWYVLLKERNMLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 803326 - protein, 260 aa, Homo sapiens; identical to SEQ ID NO: 803325

SEQ ID NO: 803327 - protein, 260 aa, Homo sapiens; identical to SEQ ID NO: 803325

SEQ ID NO: 803328 - protein, 140 aa, Homo sapiens
MLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 803329 - protein, 296 aa, Homo sapiens
GNGFCQLCENMAAAGLALLCRRVSSALKSSRSLITPQVPACTGFFLSLLPKSTPNVTSFHQYRLLHTTLSRKGLEEFFDDPKNWGQEKVKSGAAWTCQQLRNKSNEDLHKLWYVLLKERNMLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLSNAYGKAKVPELDQEVPTTEEDDATSQRQQPGEEPEPLCQADAGLQGQHQGQHRRHLPSLPKGVQRCQGWKLAGAGC

SEQ ID NO: 803330 - protein, 135 aa, Homo sapiens
RSSSVPVHMARPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 803331 - protein, 140 aa, Homo sapiens; identical to SEQ ID NO: 803328

SEQ ID NO: 803332 - protein, 257 aa, Homo sapiens
RFYRIPAMAAAGLALLCRRVSSALKSSRSLITPQVPACTGFFLSLLPKSTPNVTSFHQYRLLHTTLSRKGLEEFFDDPKNWGQEKVKSGAAWTCQQLRNKSNEDLHKLWYVLLKERNMLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 803333 - protein, 140 aa, Homo sapiens; identical to SEQ ID NO: 803328

SEQ ID NO: 803334 - protein, 141 aa, Homo sapiens
LLEDPLYCKAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 803335 - protein, 112 aa, Homo sapiens
MLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRGKHQKHMGAFPK

SEQ ID NO: 803336 - protein, 892 aa, Homo sapiens
MACLHETRTPSPSFGGFVSTLSEASMRKLDPDTSDCTPEKDLTPTQCVLRDVVPLGGQGGGGPSPSPGGEPPPEPFANSVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCWNSKPRNRPSFRQILLHLDIASADVLSTPQETYFKSQAEWREEVKLHFEKIKSEGTCLHRLEEELVMRRREELRHALDIREHYERKLERANNLYMELNALMLQLELKERELLRREQALERRCPGLLKPHPSRGLLHGNTMEKLIKKRNVPQKLSPHSKRPDILKTESLLPKLDAALSGVGLPGCPKGPPSPGRSRRGKTRHRKASAKGSCGDLPGLRTAVPPHEPGGPGSPGGLGGGPSAWEACPPALRGLHHDLLLRKMSSSSPDLLSAALGSRGRGATGGAGDPGSPPPARGDTPPSEGSAPGSTSPDSPGGAKGEPPPPVGPGEGVGLLGTGREGTSGRGGSRAGSQHLTPAALLYRAAVTRSQKRGISSEEEEGEVDSEVELTSSQRWPQSLNMRQSLSTFSSENPSDGEEGTASEPSPSGTPEVGSTNTDERPDERSDDMCSQGSEIPLDPPPSEVIPGPEPSSLPIPHQELLRERGPPNSEDSDCDSTELDNSNSVDALRPPASLPP

SEQ ID NO: 803337 - protein, 892 aa, Homo sapiens; identical to SEQ ID NO: 803336

SEQ ID NO: 803338 - protein, 385 aa, Homo sapiens
MKIYNYLKPGGRVGRPTRRNVPQKLSPHSKRPDILKTESLLPKLDAALSGVGLPGCPKGPPSPGRSRRGKTRHRKASAKGSCGDLPGLRTAVPPHEPGGPGSPGGLGGGPSAWEACPPALRGLHHDLLLRKMSSSSPDLLSAALGSRGRGATGGAGDPGSPPPARGDTPPSEGSAPGSTSPDSPGGAKGEPPPPVGPGEGVGLLGTGREGTSGRGGSRAGSQHLTPAALLYRAAVTRSQKRGISSEEEEGEVDSEVELTSSQRWPQSLNMRQSLSTFSSENPSDGEEGTASEPSPSGTPEVGSTNTDERPDERSDDMCSQGSEIPLDPPPSEVIPGPEPSSLPIPHQELLRERGPPNSEDSDCDSTELDNSNSVDALRPPASLPP

SEQ ID NO: 803339 - protein, 892 aa, Homo sapiens; identical to SEQ ID NO: 803336

SEQ ID NO: 803340 - protein, 64 aa, Homo sapiens
MLITYDDVVKISDFGTSKELSDKSTKMSFAGTVAWMAPEVIRNEPVSEKVDIWLRTRLKTEKSG

SEQ ID NO: 803341 - protein, 859 aa, Homo sapiens
MACLHETRTPSPSFGGFVSTLSEASMRKLDPDTSDCTPEKDLTPTHVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCWNSKPRNRPSFRQILLHLDIASADVLSTPQETYFKSQAEWREEVKLHFEKIKSEGTCLHRLEEELVMRRREELRHALDIREHYERKLERANNLYMELNALMLQLELKERELLRREQALERRCPGLLKPHPSRGLLHGNTMEKLIKKRNVPQKLSPHSKRPDILKTESLLPKLDAALSGVGLPGCPKGPPSPGRSRRGKTRHRKASAKGSCGDLPGLRTAVPPHEPGGPGSPGGLGGGPSAWEACPPALRGLHHDLLLRKMSSSSPDLLSAALGSRGRGATGGAGDPGSPPPARGDTPPSEGSAPGSTSPDSPGGAKGEPPPPVGPGEGVGLLGTGREGTSGRGGSRAGSQHLTPAALLYRAAVTRSQKRGISSEEEEGEVDSEVELTSSQRWPQSLNMRQSLSTFSSENPSDGEEGTASEPSPSGTPEVGSTNTDERPDERSDDMCSQGSEIPLDPPPSEVIPGPEPSSLPIPHQELLRERGPPNSEDSDCDSTELDNSNSVDALRPPASLPP

SEQ ID NO: 803342 - protein, 380 aa, Homo sapiens
MACLHETRTPSPSFGGFVSTLSEASMRKLDPDTSDCTPEKDLTPTQCVLRDVVPLGGQGGGGPSPSPGGEPPPEPFANSVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCW

SEQ ID NO: 803343 - protein, 116 aa, Homo sapiens [sequence omitted]

SEQ ID NO: 803344 - protein, 380 aa, Homo sapiens; identical to SEQ ID NO: 803342

SEQ ID NO: 803345 - protein, 76 aa, Homo sapiens
MGQHPESWMPSSCQETCFLVRYIWEMPGLLSSLISSPACKNKSPVSPHLSMALRTSWTAFTCAIVNLRRPLIWPGA

SEQ ID NO: 803346 - protein, 82 aa, Homo sapiens
MLSQKPKKKHNFLNHGLSLNLVIKPYLALEGSVAFPAENGVQDTESTQEKRETGDEENSAKFPVGRRDFDIFSDHFYQNINL

SEQ ID NO: 803347 - protein, 165 aa, Homo sapiens
MAKMNLSSYILILTFSLFSQGILLSASKSIRNLDDDMVFNTFRLGKGFQKEDTAEKSVIAPSLEQYKNDESSFMNEEENKVSKNTGSKHNFLNHGLPLNLAIKPYLALKGSVAFPAENGVQNTESTQEKREIGDEENSAKFPIGRRDFDMLRCMLGRVYRPCWQV

SEQ ID NO: 803348 - protein, 129 aa, Homo sapiens
MVFNTFRLGKGFQKEDTAEKSVIAPSLEQYKNDESSFMNEEENKVSKNTGSKHNFLNHGLPLNLAIKPYLALKGSVAFPAENGVQNTESTQEKREIGDEENSAKFPIGRRDFDMLRCMLGRVYRPCWQV

SEQ ID NO: 803349 - protein, 82 aa, Homo sapiens; identical to SEQ ID NO: 803346

SEQ ID NO: 803350 - protein, 82 aa, Homo sapiens; identical to SEQ ID NO: 803346

SEQ ID NO: 803351 - protein, 154 aa, Homo sapiens
QRKGPVEDTGRRQPSANQEQRPDQKQNLLAPDLGLAASKMPVSEEFHKMSKITEYFEYIKIYKISYSEHTEQKNTTRLYQKIHYSFEVSHTVFSFHFHEYAVGGRLDWYVQKSVDSGVIKDFCHFLKKMEGENTNHFNKLWNGFPHINTTSASK

SEQ ID NO: 803352 - protein, 198 aa, Homo sapiens
EETRRGPAPAGLTPSVCLYGRAPTASRTGPGAPAEGARAAPREGGGEAVAERCARSQPSWEGELWGVRHLVSLSLPASSGACAPPPLPPRRGEGPLLATAFAAFKLPWRLRLLPPPCLHCLFAQHTDADGGWEKGQTLLPANRRCRSRGLTKMAAAVSAATTTTTTTTRSESLSPARPVFSRETVTGGWGNGEARVLA

SEQ ID NO: 803353 - protein, 84 aa, Homo sapiens
LVIQARQGAPPSPDRERLREGRVRATRSPSKLQQVSSGTWASRFPWQPTSVALLRFTRGWFPDSFQTPLPSLRKLSRLRIPLRI

SEQ ID NO: 803354 - protein, 223 aa, Homo sapiens
MGARRQPRAPAPGPRLRVRAQHPGKVGGRRWRKDARAVSRHGRGNCGAFAILSPSPYLRPRGRAHHPPSRLGGGRAPSWPPPSRPLNSPGDCGYCHRLASTASSRSTQMRTVGGKKGRRYSQRTAAAAPEASPKWPPPSRPPPPPLPPPLARNRYRRRGPSSRERQSPSKLQQVSSGTWASRFPWQPTSVALLRFTRGWFPDSFQTPLPSLRKLSRLRIPLRI

SEQ ID NO: 803355 - protein, 965 aa, Homo sapiens
MQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAISRPLKASQMVNSCITSPSTPSKKFTFKSKSSLALCLDSDSEDELKRSVALSQRLCEMLGNEQQQEDLEKDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSGHYISDVYDIKKQAWFTYNDLEVSKIQEAAVQSDRDRSGYIFFYMHKEIFDELLETEKNSQSLSTEVGKTTRQAS

SEQ ID NO: 803356 - protein, 964 aa, Homo sapiens
MQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAISRPLKASQMVNSCITSPSTPSKKFTFKSKSSLALCLDSDSEDELKRSVALSQRLCEMLGNEQQQEDLEKDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSGHYISDVYDIKKQAWFTYNDLEVSKIQEAAVQSDRDRSGYIFFYMHKEIFDGLAGTVVRTILLGWQYALHILLQ

SEQ ID NO: 803357 - protein, 39 aa, Homo sapiens
MILIHSLDHLHLPLDQSSLQNMNCIFVVHFLAPISSRQI

SEQ ID NO: 803358 - protein, 965 aa, Homo sapiens; identical to SEQ ID NO: 803355

SEQ ID NO: 803359 - protein, 978 aa, Homo sapiens
MQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAISRPLKASQMVNSCITSPSTPSKKFTFKSKSSLALCLDSDSEDELKRSVALSQRLCEMLGNEQQQEDLEKVFWFLLKVTLFFMDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSGHYISDVYDIKKQAWFTYNDLEVSKIQEAAVQSDRDRSGYIFFYMHKEIFDELLETEKNSQSLSTEVGKTTRQAS

SEQ ID NO: 803360 - protein, 905 aa, Homo sapiens
MQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAISRPLKASQMVNSCITSPSTPSKKFTFKSKSSLALCLDSDSEDELKRSVALSQRLCEMLGNEQQQEDLEKDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAEVIVFIPEYSWSNSVSLFPLFTSKAPLSVSTAGSFWPFQ

SEQ ID NO: 803361 - protein, 510 aa, Homo sapiens
AGGGVTAASSPAQTVAAAFAQGELVAAAAAWNCGSCVCHSAAGGRRSLTMAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 803362 - protein, 461 aa, Homo sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 803363 - protein, 388 aa, Homo sapiens
AGGGVTAASSPAQTVAAAFAQGELVAAAAAWNCGSCVCHSAAGGRRSLTMAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTHLPGPLPSGPPARQDTGQPAG

SEQ ID NO: 803364 - protein, 403 aa, Homo sapiens
TVGESMGLFDVEYKPEKENSSTHRQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 803365 - protein, 341 aa, Homo sapiens
ALEIPFRSLGPLDALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 803366 - protein, 68 aa, Homo sapiens
AGGGVTAASSPAQTVAAAFAQGELVAAAAAWNCGSCVCHSAAGGRSYYFSTEANCEPWCVSLAGEEAN

SEQ ID NO: 803367 - protein, 68 aa, Homo sapiens; identical to SEQ ID NO: 803366

SEQ ID NO: 803368 - protein, 239 aa, Homo sapiens
TLKLVPGQNRSGELSSFHSASFGGTPAVCRALLLNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 803369 - protein, 486 aa, Homo sapiens
MAFGAKLALNSDSTALWLHELWSLTMAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 803370 - protein, 451 aa, Homo sapiens
MAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 803371 - protein, 318 aa, Homo sapiens [sequence omitted]

SEQ ID NO: 803372 - protein, 446 aa, Homo sapiens
AGGGVTAASSPAQTVAAAFAQGELVAAAAAWNCGSCVCHSAAGGRRSLTMAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 803373 - protein, 126 aa, Homo sapiens
ATRLPEAEVGAVRAARPWSWAGGSGRFLGLLLPAASAPSQQCSGDPHILTSVSKAGRPSGPGAPCRRPTFLIFPTQNVSIHLFIGRRWGRGNLRLALAPHLFLVPLPVSFSQPKFPYLSEEGVVWC

SEQ ID NO: 803374 - protein, 176 aa, Homo sapiens [sequence omitted]

SEQ ID NO: 803375 - protein, 445 aa, Homo sapiens
MPANVYTVHAFYYKTTEHRRKIHHLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNGAARTGRRAPPALAPGSHVRGLLPGLSHLRLAWCLYNCAAKMLQNTACLSTEK

SEQ ID NO: 803376 - protein, 401 aa, Homo sapiens
MVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNGAARTGRRAPPALAPGSHVRGLLPGLSHLRLAWCLYNCAAKMLQNTACLSTEK

SEQ ID NO: 803377 - protein, 427 aa, Homo sapiens
MPANVYTVHAFYYKTTEHRRKIHHLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSDSDTGLTQRSGS

SEQ ID NO: 803378 - protein, 255 aa, Homo sapiens
MPANVYTVHAFYYKTTEHRRKIHHLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQGV

SEQ ID NO: 803379 - protein, 105 aa, Homo sapiens [sequence omitted]

SEQ ID NO: 803380 - protein, 342 aa, Homo sapiens
TGIAPPRPKIIHPFFTPEHPELWKLAAALSGIKIWNTTYQLLRTKTKTPTFNITLISEWVIPIRSCVKPPYMLLVGNIIMMPDAQTIECHNCKLFTCIDATFNPTTSILLVRAREGVWIPVSLHRPWESSPSIHIVNEVLKDILKRTKRFIFTLIAVLAGLLAVTATAATAGVAIRSSVQTAHYVEACQKNSSRLWNSQAQIDQKLANQINDLRQSVTWLGDRVMNLQHRMQLQCDWNTSDYCITPYAYNQDQHSWENVSRHLKAWDDNLTLDISQLKEQIFEASQAHLSTVPGSHIFEGITKQLPDFNPFKWLKPVRGSLLLLALLILVCLCCLLLVCRCL

SEQ ID NO: 803381 - protein, 255 aa, Homo sapiens
MPANVYTVHAFYYKTTEHRRKIHHLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQVC

SEQ ID NO: 803382 - protein, 342 aa, Homo sapiens; identical to SEQ ID NO: 803380

SEQ ID NO: 803383 - protein, 62 aa, Homo sapiens
MGARHGYARSRRRSISKLIKAVLVERLNCWRTVVSIPAPKEQSPEFSGATKRSQRRVPTQSV

SEQ ID NO: 803384 - protein, 114 aa, Homo sapiens
ENNGGRGAEDSSMQLTTRRQKAEAGVLENLAVLEFTLTPPRSSAAEPSSPALPAARWRWFCCQLGETELGHARWRRPPCCVPFPGCWPPPGSRAALQCDQSSTCESRRMPNLTG

SEQ ID NO: 803385 - protein, 112 aa, Homo sapiens
MADAEGFPTRVTLPNTQAAVTSFPHLLWVSELAGKPGGWPACGGREGRGRPRPSFQCVVPSKRPRSYGRLGKYGSDRLLIKNSLSGAFLLDRPFIPWKESRTLCDHRLSPKC

SEQ ID NO: 803386 - protein, 112 aa, Homo sapiens; identical to SEQ ID NO: 803385

SEQ ID NO: 803387 - protein, 165 aa, Homo sapiens
MADAEGFPTRVTLPNTQAGDLLSPPPLGFGACRETWRLACLWRPGGSGQAPPIISVRGALEAPAELREARQKAEAGVLENLAVLEFTLTPPRSSAAEPSSPALPAARWRWFCCQLGETELGHARWRRPPCCVPFPGCWPPPGSRAALQCDQSSTCESRRMPNLTG

SEQ ID NO: 803388 - protein, 73 aa, Homo sapiens
AHAFFVPPFRVWCPRGFQSPSVRSKFYVREPPNAKPDWLKVGFTLGTTVFLWIYLIKQHNEDILEYKRRNGLE

SEQ ID NO: 803389 - protein, 112 aa, Homo sapiens; identical to SEQ ID NO: 803385

SEQ ID NO: 803390 - protein, 85 aa, Homo sapiens
ALGAQGIRKMAPSALLRPLSRLLAPARLPSGPSVRSKFYVREPPNAKPDWLKVGFTLGTTVFLWIYLIKQHNEDILEYKRRNGLE

SEQ ID NO: 803391 - protein, 112 aa, Homo sapiens; identical to SEQ ID NO: 803385

SEQ ID NO: 803392 - protein, 104 aa, Homo sapiens
MKWAWLSYRQKAEAGVLENLAVLEFTLTPPRSSAAEPSSPALPAARWRWFCCQLGETELGHARWRRPPCCVPFPGCWPPPGSRAALQCDQSSTCESRRMPNLTG

SEQ ID NO: 803393 - protein, 32 aa, Homo sapiens
MRTQSTTGTKRWPGLRGYTTTSARRNTLTSED

SEQ ID NO: 803394 - protein, 139 aa, Homo sapiens
MTGKNVYFQSQLEAFHCLQYELFPSRLTINLLVTTHIPFPQTKPHIARCVFTESSKILLGLWVQDGECSEIMTGAWSCRALRRKSRNLFSEQLKIIPKDLHFRNTMLSSCIRNQLGGPFLLEVENNERLNYRSGEGRQL

SEQ ID NO: 803395 - protein, 323 aa, Homo sapiens
PREARRAGPRAGGGLGRAEGEPGRKEAAGGREAGAGQELLGWSGGAAMSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803396 - protein, 189 aa, Homo sapiens
LFLERKPKSRGFRSPKGWFSGLEPAVTVSRILGPRLQLRATAGQVVGLQPCLASGLAAGSWGNPSGLLNKGQSWILAMASVSHLRHCLAALLHRAAWESRHRAPARATLATHSGPRLLEFQVSAKEYQESKENLSAPRGSQMHAQDFRKEQVMIGREAGSPGASSTYYDIFLRKVSLRETGFQPWPAGV

SEQ ID NO: 803397 - protein, 305 aa, Homo sapiens
CGTSSTHAAAGGREAGAGQELLGWSGGAAMSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803398 - protein, 323 aa, Homo sapiens; identical to SEQ ID NO: 803395

SEQ ID NO: 803399 - protein, 323 aa, Homo sapiens; identical to SEQ ID NO: 803395

SEQ ID NO: 803400 - protein, 316 aa, Homo sapiens
CGTSSTHAAAGGREAGAGQELLGWSGGAAMSDSEKLNLDSIIGRLLEGSRVLTPHCAPVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803401 - protein, 281 aa, Homo sapiens
MGPPVSPTLLLSGSRVLTPHCAPVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803402 - protein, 279 aa, Homo sapiens
PREARRAGPRAGGGLGRAEGEPGRKEAAGGREAGAGQELLGWSGGAAMSDSEKLNLDSIIGRLLEGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803403 - protein, 405 aa, Homo sapiens
PREARRAGPRAGGGLGRAEGEPGRKEAAGGREAGAGQELLGWSGGAAMSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGLVAPACGRGRGGPCLRSGLTAPILAQVVEDGYEFFAKRQLVTLFSAPNYCGEFDNAGAMMSVDETLMCSFQILKPADKNKGKYGQFSGLNPGGRPITPPRNSAKAKK

SEQ ID NO: 803404 - protein, 288 aa, Homo sapiens
CGTSSTHAAAGGREAGAGQELLGWSGGAAMSDSEKLNLDSIIGRLLEVQGSRPGKNVQLTENEIRGLCLKSREIFLSQPILLELEAPLKICGDIHGQYYDLLRLFEYGGFPPESNYLFLGDYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803405 - protein, 137 aa, Homo sapiens
MCLTRACCVTCCGLTLTRTVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 803406 - protein, 137 aa, Homo sapiens; identical to SEQ ID NO: 803405

SEQ ID NO: 803407 - protein, 288 aa, Homo sapiens
PREARRAGPRAGGGLGRAEGEPGRKEAAGGREAGAGQELLGWSGGAAMSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803408 - protein, 311 aa, Homo sapiens
PREARRAGPRAGGGLGRAEGEPGRKEAAGGREAGAGQELLGWSGGAAMSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGVQPVRSCPRALCPF

SEQ ID NO: 803409 - protein, 198 aa, Homo sapiens
PREARRAGPRAGGGLGRAEGEPGRKEAAGGREAGAGQELLGWSGGAAMSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECEWSERLGLPGS

SEQ ID NO: 803410 - protein, 66 aa, Homo sapiens
DGYEFFAKRQLVTLFSAPNYCGEFDNAGAMMSVDETLMCSFQVSVGKKGAASPVAQPHEPDQHCLF

SEQ ID NO: 803411 - protein, 136 aa, Homo sapiens
HRCLTLSSQPRLNSPGTLAEGGVGRHLTATSPWAGKRRYNIKLWKTFTDCFNCLPIAAIVDEKIFCCHGGEGGDGWGGGALAASLSTRQLSLGLIWEVTPSRKCPPYPTVLGCTHFLDVCPTWSGLVSFLPGALCS

SEQ ID NO: 803412 - protein, 323 aa, Homo sapiens; identical to SEQ ID NO: 803395

SEQ ID NO: 803413 - protein, 323 aa, Homo sapiens; identical to SEQ ID NO: 803395

SEQ ID NO: 803414 - protein, 309 aa, Homo sapiens
HSLGFEALRFYAGREAVQPGLVCCWAWSGGARHVRQPRMLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803415 - protein, 359 aa, Homo sapiens
MPVEAAGIQAEIWPGAAAMRQELGLEKAPGRQEQGLQRLFSSQSWACSCHWEAEGGPGEFDLRKFWAYIGRHELDRNWAKKGCCEAAVVPVDPAKRKRWAWRSPHEVEVGPVDADRRQELRLESQLEEILRQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDRAGLGRERPWRLFYLWSRGGGQVPPQARLGPHLPSTPGGRRRLRVLCQAAAGDTFLSSQLLWRV

SEQ ID NO: 803416 - protein, 323 aa, Homo sapiens; identical to SEQ ID NO: 803395

SEQ ID NO: 803417 - protein, 137 aa, Homo sapiens; identical to SEQ ID NO: 803405

SEQ ID NO: 803418 - protein, 137 aa, Homo sapiens; identical to SEQ ID NO: 803405

SEQ ID NO: 803419 - protein, 125 aa, Homo sapiens
LWVIVAVGRPWLWVERGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 803420 - protein, 278 aa, Homo sapiens
MDKSGIDSLDHVTSDAVELANRSDNSSDSSLFKTQCIPYSPKGEKRNPIRKFVRTPESVHASDSSSDSSFEPIPLTIKAIFERFKNRKKRYKKKKKRRYQPTGRPRGRPEGRRNPIYSLIDKKKQFRSRGSGFPFLESENEKNAPWRKILTFEQAVARGFFNYIEKLKYEHHLKESLKQMNVGEDLENEDFDSRRYKFLDDDGSISPIEESTAEDEDATHLEDNECDIKLAGDSFIVSSEFPVRLSVYLEEEDITEEAALSKKRATKAKNTGQRGLKM

SEQ ID NO: 803421 - protein, 278 aa, Homo sapiens; identical to SEQ ID NO: 803420

SEQ ID NO: 803422 - protein, 278 aa, Homo sapiens; identical to SEQ ID NO: 803420

SEQ ID NO: 803423 - protein, 278 aa, Homo sapiens; identical to SEQ ID NO: 803420

SEQ ID NO: 803424 - protein, 278 aa, Homo sapiens; identical to SEQ ID NO: 803420

SEQ ID NO: 803425 - protein, 215 aa, Homo sapiens
MDKSGIDSLDHVTSDAVELANRSDNSSDSSLFKTQCIPYSPKGEKRNPIRKFVRTPESVHASDSSSDSSFEPIPLTIKAIFERFKNRKKRYKKKKKRRYQPTGRPRGRPEGRRNPIYSLIDKKKQFRSRGSGFPFLESENEKNAPWRKILTFEQAVARGFFNYIEKLKYEHHLKESLKQMNVGEDLENEDFDSRRYKFLDDDGSISPIEESTLLS

SEQ ID NO: 803426 - protein, 278 aa, Homo sapiens; identical to SEQ ID NO: 803420

SEQ ID NO: 803427 - protein, 278 aa, Homo sapiens; identical to SEQ ID NO: 803420

SEQ ID NO: 803428 - protein, 278 aa, Homo sapiens; identical to SEQ ID NO: 803420

SEQ ID NO: 803429 - protein, 278 aa, Homo sapiens; identical to SEQ ID NO: 803420

SEQ ID NO: 803430 - protein, 278 aa, Homo sapiens; identical to SEQ ID NO: 803420

SEQ ID NO: 803431 - protein, 278 aa, Homo sapiens; identical to SEQ ID NO: 803420

SEQ ID NO: 803432 - protein, 278 aa, Homo sapiens; identical to SEQ ID NO: 803420

SEQ ID NO: 803433 - protein, 212 aa, Homo sapiens [sequence omitted]

SEQ ID NO: 803434 - protein, 278 aa, Homo sapiens; identical to SEQ ID NO: 803420

SEQ ID NO: 803435 - protein, 278 aa, Homo sapiens; identical to SEQ ID NO: 803420

SEQ ID NO: 803436 - protein, 278 aa, Homo sapiens; identical to SEQ ID NO: 803420

SEQ ID NO: 803437 - protein, 278 aa, Homo sapiens; identical to SEQ ID NO: 803420

SEQ ID NO: 803438 - protein, 278 aa, Homo sapiens; identical to SEQ ID NO: 803420

SEQ ID NO: 803439 - protein, 278 aa, Homo sapiens; identical to SEQ ID NO: 803420

SEQ ID NO: 803440 - protein, 278 aa, Homo sapiens; identical to SEQ ID NO: 803420

SEQ ID NO: 803441 - protein, 278 aa, Homo sapiens; identical to SEQ ID NO: 803420

SEQ ID NO: 803442 - protein, 278 aa, Homo sapiens; identical to SEQ ID NO: 803420

SEQ ID NO: 803443 - protein, 278 aa, Homo sapiens; identical to SEQ ID NO: 803420

SEQ ID NO: 803444 - protein, 67 aa, Homo sapiens
EVIGLTILFCIHYKRAGVLFQMFSWEGCREGGVYRALGLTHQASRGFWAEAWVTSSKCAVGATARPF

SEQ ID NO: 803445 - protein, 106 aa, Homo sapiens
MATPGPVIPEVPFEPSKPPVIEGLSPTVYRNPESFKEKFVRKTRENPVVPIGCLATAAALTYGLYSFHRGNSQRSQLMMRTRIAAQGFTVAAILLGLAVTAMKSRP

SEQ ID NO: 803446 - protein, 106 aa, Homo sapiens; identical to SEQ ID NO: 803445

SEQ ID NO: 803447 - protein, 75 aa, Homo sapiens
MATPGPVIPEVPFEPSKPPVIEGLSPTVYRNPSQNRSNGTCHSAAGAPSYLTASRFVCGTTRSSGDSVSRMYIHY

SEQ ID NO: 803448 - protein, 106 aa, Homo sapiens; identical to SEQ ID NO: 803445

SEQ ID NO: 803449 - protein, 105 aa, Homo sapiens
MTCGARPAVSQLLCPLLRLPGHGGRPHLRPLLLPPGQQPALSAHDAHPDRRPGFHGRSHLAGSGCHCYEVSTLSPGSGLESSAEMIPKPREQPLALPWDLLPPLL

SEQ ID NO: 803450 - protein, 106 aa, Homo sapiens; identical to SEQ ID NO: 803445

SEQ ID NO: 803451 - protein, 481 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 803452 - protein, 494 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 803453 - protein, 124 aa, Homo sapiens
APYYYYICGRSTKKARSRTVAKKLVAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMG

SEQ ID NO: 803454 - protein, 117 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVVFRPRLFLLCFGIIFLIG

SEQ ID NO: 803455 - protein, 117 aa, Homo sapiens; identical to SEQ ID NO: 803454

SEQ ID NO: 803456 - protein, 494 aa, Homo sapiens; identical to SEQ ID NO: 803452

SEQ ID NO: 803457 - protein, 372 aa, Homo sapiens
RTTRKLAQRGCQWSLPERMPLVVFCGLPYSGKSRRAEELRVALAAEGRAVYVVDDAAVLGAEDPAVYGDSAREKALRGALRASVERRLSRHDVVILDSLNYIKGFRYELYCLARAARTPLCLVYCVRPGGPIAGPQVAGANENPGRNVSVSWRPRAEEDGRAQAAGSSVLRELHTADSVVNGSAQADVPKELEREESGAAESPALVTPDSEKSAKHGSGAFYSPELLEALTLRFEAPDSRNRWDRPLFTLVGLEEPLPLAGIRSALFENRAPPPHQSTQSQPLASGSFLHQLDQVTSQVLAGLMEAQKSAVPGDLLTLPGTTEHLRFTRPLTMAELSRLRRQFISYTKMHPNNENLPQLANMFLQYLSQSLH

SEQ ID NO: 803458 - protein, 363 aa, Homo sapiens
RTTRKLAQRGCQWSLPERMPLVVFCGLPYSGKSRRAEELRVALAAEGRAVYVVDDAAVLGAEDPAVYGDSAREKALRGALRASVERRLSRHDVVILDSLNYIKGFRYELYCLARAARTPLCLVYCVRPGGANENPGRNVSVSWRPRAEEDGRAQAAGSSVLRELHTADSVVNGSAQADVPKELEREESGAAESPALVTPDSEKSAKHGSGAFYSPELLEALTLRFEAPDSRNRWDRPLFTLVGLEEPLPLAGIRSALFENRAPPPHQSTQSQPLASGSFLHQLDQVTSQVLAGLMEAQKSAVPGDLLTLPGTTEHLRFTRPLTMAELSRLRRQFISYTKMHPNNENLPQLANMFLQYLSQSLH

SEQ ID NO: 803459 - protein, 346 aa, Homo sapiens
AGTGSGLWACGREVTLSSAAPAALCPRWIPRRGSFKSLAGRPPLGRSPAMRALRAGLTLALGAGLGAVVEGWRRRREDARAAPGLLGRLPVLPVAAAAELPPVPGGPRGPGELAKYGLPGLAQSRAASRTCCATTRAPAARSGWWSSCDPSVSAANGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 803460 - protein, 358 aa, Homo sapiens
TRLGSAAPFWVPRPKPLAVFVSGREVTLSSAAPAALCPRWIPRRGSFKSLAGRPPLGRSPAMRALRAGLTLALGAGLGAVVEGWRRRREDARAAPGLLGRLPVLPVAAAAELPPVPGGPRGPGELAKYGLPGLAQSRAASRTCCATTRAPAARSGWWSSCDPSVSAANGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 803461 - protein, 108 aa, Homo sapiens
MSAQGHSSCPGKVETRGAAEPPTHPRPLLPLTGPGLPQALGQYQFPTHLVSWQACQLPCLESPHSTSTAKDLSGTPDHLSSAHGQQQALNLPPLLPAVTSWHAHPILF

SEQ ID NO: 803462 - protein, 206 aa, Homo sapiens
PSREGSLGRTPGGHGPDHAQTQEGGEGRRARGGRGRTYSSSLKRSRPAATYLPPACSASSPSTRCPRVGVKRRRTPNGTSTCSVSCSSSASKVEFDRFSPSVFQDSWPRVGNLSFSTRGGGVQSHWEAVRNRAIAAGVRCQARAIQNASSLGNDSKGEGVFGRIVPTLGKDRPVPLSDSRQSVGYMLRLEVHTEGTDIDIMSINIL

SEQ ID NO: 803463 - protein, 185 aa, Homo sapiens
PSREGSLGRTPGGHGPDHAQTQEGGEGRRARGGRGRTYSSSLKRSRPAATYLPPACSASSPSTRCPRVGVKRRRTPNGTSTCSVSCSSSASKVAARRRDSTNFLPTYNGSPLRYTTMVLAGVVSTGAEGPRVPIAAPRSSLAGAERLRQRGQRRLQSRAQARAPPTGGPLQPLAQDGDGTGTGRG

SEQ ID NO: 803464 - protein, 278 aa, Homo sapiens
ARGLEALYRPAGAPLLRVPRPSPLPAPLWDPPAAFPTNEIFAMSKRKWRGFRGAQQERAQPPAASPQPCPAPHAGLPGGSRRRAPAPAGQQQMRAESRSGAQRRRGSARRGAHREAGGCVRGRTRSSGSERSNALWQAVDAAEALALSSPLRRPWDQAQHFTNPAPVSKGPQSAPPSPPAGRRRRGADLALAPLAGEGHTRWRQPAGLGSRTKDPNCNPPHQTAQTTPRLLNLPKAKRAPLPGPRCRGDCGEPALPTPALAPRRKHLEPTTELQIPAV

SEQ ID NO: 803465 - protein, 241 aa, Homo sapiens
ARGLEALYRPAGAPLLRVPRPSPLPAPLWDPPAAFPTNEIFAMSKRKWRGFRGAQQERAQPPAASPQPCPAPHAGLPGGSRRRAPAPAGQQQMRAESRSGAQRRRGSARRGAHREAGGCVRGRTRSSGSERSNALWQAVDAAEGRRRRGADLALAPLAGEGHTRWRQPAGLGSRTKDPNCNPPHQTAQTTPRLLNLPKAKRAPLPGPRCRGDCGEPALPTPALAPRRKHLEPTTELQIPAV

SEQ ID NO: 803466 - protein, 70 aa, Homo sapiens
MQAALGAVTWSRGQGDSILEPEMSDSSSSSHSMDEKKETAGVVGTGVRCVPLTPYLKTRMASCDLMVSDA

SEQ ID NO: 803467 - protein, 83 aa, Homo sapiens
RKKLSSTSVTNSWVTKVHILASSPARSSGSQGPGTTGACLSFSTGTPESPGTPCIPPPYLSGLLSWSLTVSLSVGRTPNGPLG

SEQ ID NO: 803468 - protein, 339 aa, Homo sapiens
SAERPLAAAAGGEDAAAAGGGGGPGAAEEEALEWCKCLLAGGGGYDEFCAAVRAYDPAALCGLVWTANFVAYRCRTCGISPCMSLCAECFHQGDHTGHDFNMFRSQAGGACDCGDSNVMRESGFCKRHQIKSSSNIPCVPKDLLMMSEFVLPRFIFCLIQYLREGYNEPAADGPSEKDLNKVLQLLEPQISFLEDLTKMGGAMRSVLTQVLTNQQNYKDLTSGLGENACVKKSHEKYLIALKSSGLTYPEDKLVYGVQEPSAGTSSLAVQGFIGATGTLGQVDSSDEDDQDGSQGLGKRKRVKLSSGTKDQSIMDVLKHKSFLEELLFWTIKYEFPQKM

SEQ ID NO: 803469 - protein, 197 aa, Homo sapiens
GVCGTWRSAAGSGRAARVNTAKGLSGENGSNKMFFYPEKEEKKKWKDLKLMKKLERQRAQEEQAKRLEEEEAAAEKEDRGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGNAVWARPPISPGSCHRH

SEQ ID NO: 803470 - protein, 350 aa, Homo sapiens
GVCGTWRSAAGSGRAARVNTAKGLSGENGSNKMFFYPEKEEKKKWKDLKLMKKLERQRAQEEQAKRLEEEEAAAEKEDRGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRKPSSSPWPPCSLASPRRVPGTPESSKGPRTSVKQQ

SEQ ID NO: 803471 - protein, 386 aa, Homo sapiens
GVCGTWRSAAGSGRAARVNTAKGLSGENGSNKMFFYPEKEEKKKWKDLKLMKKLERQRAQEEQAKRLEEEEAAAEKEDRGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEEAILISLAALQPGLTQAGARHT

SEQ ID NO: 803472 - protein, 326 aa, Homo sapiens
IPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKVCR

SEQ ID NO: 803473 - protein, 218 aa, Homo sapiens
MLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACICPSHLHSHGRTDTEEKPYKCQACGQTFQHPRYLSHHVKTHTAEKTYKCEQCRMAFNGFASFTRHVRTHTKDR

SEQ ID NO: 803474 - protein, 276 aa, Homo sapiens
EYLYLSAAPAARPRRARLGEPRSRGDMDSVVFEDVAVDFTLEEWALLDSAQRDLYRDVMLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACICPSHLHSHGRTDTEEKPYKCQACGQTFQHPRYLSHHVKTHTAEKTYKCEQCRMAFNGFASFTRHVRTHTKDR

SEQ ID NO: 803475 - protein, 218 aa, Homo sapiens; identical to SEQ ID NO: 803473

SEQ ID NO: 803476 - protein, 90 aa, Homo sapiens
RTNQGGDLGHITVIELLHSLSDLVLVGFNIHSEHKRVVFFYLLHGRLSGQRKLDDSIVAKLVSPGGALPRISGLPPESQCLGPPEDIISP

SEQ ID NO: 803477 - protein, 157 aa, Homo sapiens
MLAGRLKPDEGGEVPVLNVSYKPQKISPKSTGSVRQLLHEKIRDAYTHPQFVTDVMKPLQIENIIDQEVQTLSGGELQRVALALCLGKPADVYLIDEPSAYLDSEQRLMAARVVKRFILHAKKTAFVVEHDFIMATYLADRVIVFDGVPSKNTVANR

SEQ ID NO: 803478 - protein, 599 aa, Homo sapiens
MADKLTRIAIVNHDKCKPKKCRQECKKSCPVVRMGKLCIEVTPQSKIAWISETLCIGCGICIKKCPFGALSIVNLPSNLEKETTHRYCANAFKLHRLPIPRPGEVLGLVGTNGIGKSTALKILAGKQKPNLGKYDDPPDWQEILTYFRGSELQNYFTKILEDDLKAIIKPQYVDQIPKAAKGTVGSILDRKDETKTQAIVCQQLDLTHLKERNVEDLSGGELQRFACAVVCIQKADIFMFDEPSSYLDVKQRLKAAITIRSLINPDRYIIVVEHDLSVLDYLSDFICCLYGVPSAYGVVTMPFSVREGINIFLDGYVPTENLRFRDASLVFKVAETANEEEVKKMCMYKYPGMKKKMGEFELAIVAGEFTDSEIMVMLGENGTGKTTFIRMLAGRLKPDEGGEVPVLNVSYKPQKISPKSTGSVRQLLHEKIRDAYTHPQFVTDVMKPLQIENIIDQEVQTLSGGELQRVALALCLGKPADVYLIDEPSAYLDSEQRLMAARVVKRFILHAKKTAFVVEHDFIMATYLADRVIVFDGVPSKNTVANSPQTLLAGMNKFLSQLEITFRRDPNNYRPRINKLNSIKDVEQKKSGNYFFLDD

SEQ ID NO: 803479 - protein, 599 aa, Homo sapiens; identical to SEQ ID NO: 803478

SEQ ID NO: 803480 - protein, 599 aa, Homo sapiens; identical to SEQ ID NO: 803478

SEQ ID NO: 803481 - protein, 599 aa, Homo sapiens; identical to SEQ ID NO: 803478

SEQ ID NO: 803482 - protein, 326 aa, Homo sapiens
MADKLTRIAIVNHDKCKPKKCRQECKKSCPVVRMGINIFLDGYVPTENLRFRDASLVFKVAETANEEEVKKMCMYKYPGMKKKMGEFELAIVAGEFTDSEIMVMLGENGTGKTTFIRMLAGRLKPDEGGEVPVLNVSYKPQKISPKSTGSVRQLLHEKIRDAYTHPQFVTDVMKPLQIENIIDQEVQTLSGGELQRVALALCLGKPADVYLIDEPSAYLDSEQRLMAARVVKRFILHAKKTAFVVEHDFIMATYLADRVIVFDGVPSKNTVANSPQTLLAGMNKFLSQLEITFRRDPNNYRPRINKLNSIKDVEQKKSGNYFFLDD

SEQ ID NO: 803483 - protein, 289 aa, Homo sapiens
AVVSTQSRHYGRGFRDASLVFKVAETANEEEVKKMCMYKYPGMKKKMGEFELAIVAGEFTDSEIMVMLGENGTGKTTFIRMLAGRLKPDEGGEVPVLNVSYKPQKISPKSTGSVRQLLHEKIRDAYTHPQFVTDVMKPLQIENIIDQEVQTLSGGELQRVALALCLGKPADVYLIDEPSAYLDSEQRLMAARVVKRFILHAKKTAFVVEHDFIMATYLADRVIVFDGVPSKNTVANSPQTLLAGMNKFLSQLEITFRRDPNNYRPRINKLNSIKDVEQKKSGNYFFLDD

SEQ ID NO: 803484 - protein, 154 aa, Homo sapiens
MKPLQIENIIDQEVQTLSGGELQRVALALCLGKPADVYLIDEPSAYLDSEQRLMAARVVKRFILHAKKTAFVVEHDFIMATYLADRVIVFDGVPSKNTVANSPQTLLAGMNKFLSQLEITFRRDPNNYRPRINKLNSIKDVEQKKSGNYFFLDD

SEQ ID NO: 803485 - protein, 154 aa, Homo sapiens; identical to SEQ ID NO: 803484

SEQ ID NO: 803486 - protein, 599 aa, Homo sapiens [sequence omitted]

SEQ ID NO: 803487 - protein, 243 aa, Homo sapiens [sequence omitted]

SEQ ID NO: 803488 - protein, 243 aa, Homo sapiens [sequence omitted]

SEQ ID NO: 803489 - protein, 130 aa, Homo sapiens
MVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSNFA

SEQ ID NO: 803490 - protein, 243 aa, Homo sapiens [sequence omitted]

SEQ ID NO: 803491 - protein, 228 aa, Homo sapiens
MVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 803492 - protein, 243 aa, Homo sapiens [sequence omitted]

SEQ ID NO: 803493 - protein, 161 aa, Homo sapiens
MADGWETARRLDRPPILENDENGILLVPGCEWAVFRLAHPGVITRIEIDTKYFEGNAPDSCKVDGCILTTQEEAVIRQKWILPAHKWKPLLPVTKLSPNQSHLFDSLTLELQDVITHARLTIVPDGGVSRLRLRGFPSSICLLRPREKPMLKFSVSFKANP

SEQ ID NO: 803494 - protein, 409 aa, Homo sapiens
MADAPKEGRLTRFLDFTQLMDMASESVGGKILFATDDFFAPAENLIKSDSPCFKEHEYTEFGKWMDGWETRRKRIPGHDWCVLRLGIQGVIRGFDVDVSYFTGDYAPRVSIQAANLEEDKLPEIPERGIRTGAAATPEEFEAIAELKSDDWSYLVPMTELKPGNPASGHNYFLVNSQQRWTHIRLNIFPDGGIARLRVFGTGQKDWTATDPKEPADLVAIAFGGVCVGFSNAKFGHPNNIIGVGGAKSMADGWETARRLDRPPILENDENGILLVPGCEWAVFRLAHPGVITRIEIDTKYFEGNAPDSCKVDGCILTTQEEAVIRQKWILPAHKWKPLLPVTKLSPNQSHLFDSLTLELQDVITHARLTIVPDGGVSRLRLRGFPSSICLLRPREKPMLKFSVSFKANP

SEQ ID NO: 803495 - protein, 486 aa, Homo sapiens
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSQDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 803496 - protein, 486 aa, Homo sapiens; identical to SEQ ID NO: 803495

SEQ ID NO: 803497 - protein, 486 aa, Homo sapiens; identical to SEQ ID NO: 803495

SEQ ID NO: 803498 - protein, 329 aa, Homo sapiens
MLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 803499 - protein, 301 aa, Homo sapiens
MLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGFVSFDNPASAQTAIQAMNGFQIGMKRLKVQLKRPKDANRPY

SEQ ID NO: 803500 - protein, 486 aa, Homo sapiens; identical to SEQ ID NO: 803495

SEQ ID NO: 803501 - protein, 301 aa, Homo sapiens; identical to SEQ ID NO: 803499

SEQ ID NO: 803502 - protein, 273 aa, Homo sapiens
MLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGRFVSFDNPASAQTAIQAMNGFQIGMKRLKVQLKRPKDANRPY

SEQ ID NO: 803503 - protein, 349 aa, Homo sapiens
MLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGNVISSKVFVDRATNQSKCFGFVSFDNPASAQTAIQAMNGFQIGMKRLKVQLKRPKDANRPY

SEQ ID NO: 803504 - protein, 329 aa, Homo sapiens; identical to SEQ ID NO: 803498

SEQ ID NO: 803505 - protein, 329 aa, Homo sapiens; identical to SEQ ID NO: 803498

SEQ ID NO: 803506 - protein, 684 aa, Homo sapiens
MQDDLLMDKSKTQPQPQQQQRQQQQPQPESSVSEAPSTPLSSETPKPEENSAVPALSPAAAPPAPNGPDKMQMESPLLPGLSFHQPPQQPPPPQEPAAPGASLSPSFGSTWSTGTTNAVEDSFFQGITPVNGTMLFQNFPHHVNPVFGGTFSPQIGLAQTQHHQQPPPPAPAPQPAQPAQPPQAQPPQQRRSPASPSQAPYAQRSAAAAYGHQPIMTSKPSSSSAVAAAAAAAAASSASSSWNTHQSVNAAWSAPSNPWGGLQAGRDPRRAVGVGVGVGVGVPSPLNPISPLKKPFSSNVIAPPKFPRAAPLTSKSWMEDNAFRTDNGNNLLPFQDRSRPYDTFNLHSLENSLMDMIRTDHEPLKGRMGINFHHPGTDNIMALNSRSSLFPFEDAFLDDSHGDQALSSGLSSPTRCQNGERVERYSRKVFVGGLPPDIDEDEITASFRRFGPLVVDWPHKAESKSYFPPKGYAFLLFQEESSVQALIDACLEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHNDIDKRVEVKPYVLDDQMCDECQGTRCGGKFAPFFCANVTCLQYYCEYCWASIHSRAGREFHKPLVKEGGDRPRHVPFRWS

SEQ ID NO: 803507 - protein, 684 aa, Homo sapiens; identical to SEQ ID NO: 803506

SEQ ID NO: 803508 - protein, 485 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRRDFAFVASDKDSCMLKCHVFRCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 803509 - protein, 539 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLAVIPTDADPQYLNPWTQILCCGPRTASPAWSSPGWGGWAQLSRDSLGRVREAGLIPFCAPTCFRNSDSRDFAFVASDKDSCMLKCHVFRCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 803510 - protein, 495 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRLPQPHLCPWLRDFAFVASDKDSCMLKCHVFRCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 803511 - protein, 263 aa, Homo sapiens
MLKCHVFRCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 803512 - protein, 263 aa, Homo sapiens; identical to SEQ ID NO: 803511

SEQ ID NO: 803513 - protein, 263 aa, Homo sapiens; identical to SEQ ID NO: 803511

SEQ ID NO: 803514 - protein, 439 aa, Homo sapiens
MLGKDYMLAIILVNCDDDLWGDHSLEVEAGLPPGWRKIHDAAGTYYWHVPSGSTQWQRPTWELGDAEDPGTCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRRDFAFVASDKDSCMLKCHVFRCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 803515 - protein, 374 aa, Homo sapiens
MEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRRDFAFVASDKDSCMLKCHVFRCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 803516 - protein, 121 aa, Homo sapiens [sequence omitted]

SEQ ID NO: 803517 - protein, 239 aa, Homo sapiens
MLKCHVFRCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPCPLPEIKNSLT

SEQ ID NO: 803518 - protein, 209 aa, Homo sapiens [sequence omitted]

SEQ ID NO: 803519 - protein, 209 aa, Homo sapiens [sequence omitted]

SEQ ID NO: 803520 - protein, 839 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 803521 - protein, 860 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 803522 - protein, 727 aa, Homo sapiens
MQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 803523 - protein, 643 aa, Homo sapiens
QVIMLTALPLTSCCVAQFLTATDSYWSAAQGRWELLINPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 803524 - protein, 870 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKDLQYSVEYELAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 803525 - protein, 737 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELESCCITQAGVQWCYHSSLQPQPPGLRQSSFLSLPGELGPQDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 803526 - protein, 823 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIR

SEQ ID NO: 803527 - protein, 207 aa, Homo sapiens
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVVSYFYFFILYYSFCFHKWTKFKSMSLEEVREWEQKV

SEQ ID NO: 803528 - protein, 206 aa, Homo sapiens
MNFQQRLQSLWTLARPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 803529 - protein, 442 aa, Homo sapiens
MPASGAPTPSRHVSLPTLAGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 803530 - protein, 202 aa, Homo sapiens
DAWVDPRVRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 803531 - protein, 181 aa, Homo sapiens
MEHGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFSGPQPGPGATPNPRTVHRSHEQTAARTRETRAPAIPTTAP

SEQ ID NO: 803532 - protein, 196 aa, Homo sapiens
TLRGSPLRLPRLCAQLLERAGCLGPAAAAAGTAAAAAGWGEQVEQHEHKAHGTAQQCGEACVESLGLWARKVHAHVVLVRLVVVQAGPSGQAHEESRMLLLYVAYGQAAVGQHRDAAIAGSWRPEKLLLRRNPGNAHGRDAGVAVKPQGPTHQRVQVLFRPLRPRAGADEQFSKTRLCWKKRTRDAGTLKAKHTYS

SEQ ID NO: 803533 - protein, 991 aa, Homo sapiens
MMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEGQPALGTGEGGRCVCAHEGAWRCPCLGGTWGTLVVEPWPKPAPHLLEPEGHVPHLTSSGGRTTGQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTNHHIQPPCLPVSSLVGAQPWP

SEQ ID NO: 803534 - protein, 875 aa, Homo sapiens
PRLRSFNSSENAVAGEHAHALPPRQGKESTEMKEETAEERLRRRAYERGCQRLRKRIEVVEELQVQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTNHHIQPPCLPVSSLVGAQPWP

SEQ ID NO: 803535 - protein, 990 aa, Homo sapiens
MMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEGQPALGTGEGGRCVCAHEGAWRCPCLGGTWGTLVVEPWPKPAPHLLEPEGHVPHLTSSGGRTTGQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 803536 - protein, 961 aa, Homo sapiens
MMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEGQPALGTGEGGRCVCAHEGAWRCPCLGGTWGTLVVEPWPKPAPHLLEPEGHVPHLTSSGGRTTGQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEEDPDPPGCHSRQTLCRRTHCGHWRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 803537 - protein, 426 aa, Homo sapiens
MEHGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 803538 - protein, 990 aa, Homo sapiens; identical to SEQ ID NO: 803535

SEQ ID NO: 803539 - protein, 112 aa, Homo sapiens
TCLWTLALRLGASGGVVLSTEDCALSSWSGLGVWGQRRQRQARRQQRQGGANRRGPVARHTKSPACCSCTLPMAKLPSASTAMLPSRDPGALRSSCCGETQAMRMAGTLVLQ

SEQ ID NO: 803540 - protein, 990 aa, Homo sapiens; identical to SEQ ID NO: 803535

SEQ ID NO: 803541 - protein, 979 aa, Homo sapiens
MMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEGQPALGTGEGGRCVCAHEGAWRCPCLGGTWGTLVVEPWPKPAPHLLEPEGHVPHLTSSGGRTTGQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTTQSQAGPYL

SEQ ID NO: 803542 - protein, 984 aa, Homo sapiens
MMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEGQPALGTGEGGRCVCAHEGAWRCPCLGGTWGTLVVEPWPKPAPHLLEPEGHVPHLTSSGGRTTGQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKPPHPTSLPACILIGGSPAMALIVPELDFQSGPQ

SEQ ID NO: 803543 - protein, 828 aa, Homo sapiens
MMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEGQPALGTGEGGRCVCAHEGAWRCPCLGGTWGTLVVEPWPKPAPHLLEPEGHVPHLTSSGGRTTGQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQCVGPGGHTPWPQAPCPASPRLSPPCPHRRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQVWPSGQQGWDP

SEQ ID NO: 803544 - protein, 212 aa, Homo sapiens
MASKGAGMSFSRKSYRLTSDAEKSRVTGIVQEKLLNDYLNRIFSSSEHAPPAATSRKPLNFQNLPEHLDQLLQVDNEEEESQGQVEGRLGPSTVVLDHTGGFEGLLLVDDDLLGVIGHSNFGTIRSTTCVYKGKWLYEVLISSQGLMQIGWCTISCRFNQEEGVGDTHNSYAYDGNRVRKWNVTTTNYGKAWAAGDIVSCLIDLDDGTLSFC

SEQ ID NO: 803545 - protein, 468 aa, Homo sapiens
MMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEGQPALGTGEGGRCVCAHEGAWRCPCLGGTWGTLVVEPWPKPAPHLLEPEGHVPHLTSSGGRTTGQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKTTTSNLLACLYPHWWEPSHGPNCA

SEQ ID NO: 803546 - protein, 174 aa, Homo sapiens
MASKGAGMSFSRKSYRLTSDAEKSRVTGIVQEKLLNDYLNRIFSSSEHAPPAATSRKPLNFQNLPEHLDQLLQVDNEEEESQGQVEGRLGPSTVVLDHTGGFEGLLLVDDDLLGVIGHSNFGTIRSTTCVYKGKWLYEVLIPPHPTSLPACILIGGSPAMALIVPELDFQSGPQ

SEQ ID NO: 803547 - protein, 591 aa, Homo sapiens
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPWPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNSSIQCICQEWLEKKNVYLHEMHRIKRIESENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKEKINEKRKEELKRAEKKDKDKQAINEYEKWLENKEKQERIERKQKKRHSFLESEALPPWSPPSRTVFAKVF

SEQ ID NO: 803548 - protein, 647 aa, Homo sapiens [sequence omitted]

SEQ ID NO: 803549 - protein, 236 aa, Homo sapiens
MIDRARSWLADTEGQLFISEWLEKKNVYLHEMHRIKRIESENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKEKINEKRKEELKRAEKKDKDKQAINEYEKWLENKEKQERIERKQKKRHSFLESEALPPWSPPSRTVFAKVF

SEQ ID NO: 803550 - protein, 541 aa, Homo sapiens
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEESAVTGIVVGALLGAGLLMAFYFFRKKYRITIERRTQQEESNLGKHRELREDSIRSHFSVA

SEQ ID NO: 803551 - protein, 266 aa, Homo sapiens
PSLRGSMAEGCAVYGTWPWGGMFQLFRPSALAGLCSIGLVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSWWLKRNRE

SEQ ID NO: 803552 - protein, 305 aa, Homo sapiens
EAAWMRTEMFQLTTPGILQTLVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEESAVTGIVVGALLGAGLLMAFYFFRKKYRITIERRTQQEESNLGKHRELREDSIRSHFSVA

SEQ ID NO: 803553 - protein, 688 aa, Homo sapiens
RGSDVGVSTCKMAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 803554 - protein, 665 aa, Homo sapiens
MFALLVLKIYFSSLNMCLEDFKKLRQYTIGSQKELLGMFVCVRERICEFEIMLHCCKISFQSLSHTTKEFVNSLLLLVISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 803555 - protein, 163 aa, Homo sapiens
MEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSLMGT

SEQ ID NO: 803556 - protein, 665 aa, Homo sapiens; identical to SEQ ID NO: 803554

SEQ ID NO: 803557 - protein, 607 aa, Homo sapiens
MEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 803558 - protein, 668 aa, Homo sapiens
MRGSDVISRMIVGEPGTDYGVNASADGSSTKKRVHMPVEYAIDKKMLSDNLEHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 803559 - protein, 502 aa, Homo sapiens
MNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 803560 - protein, 265 aa, Homo sapiens
MVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 803561 - protein, 77 aa, Homo sapiens
NSTRTYFVTKTLLLTSSNNEKPGEQEKEEDIAVLAEEKIELLCQDQVLDPNMDLRTVKHFIWKSGGDLTLHYRQKST

SEQ ID NO: 803562 - protein, 585 aa, Homo sapiens
RGSDVGVSTCKMAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKICQFTNSFTSPMHLGQT

SEQ ID NO: 803563 - protein, 688 aa, Homo sapiens; identical to SEQ ID NO: 803553

SEQ ID NO: 803564 - protein, 148 aa, Homo sapiens
LEEGAGVGLLALVAQARDPRGRHSEPGIACRRSSVGVDLRGRDRLVPRPLASPLPCLSSKRSALAASEPRPPGVSQGGGRWRSERLVRGRGEAAERQRPCGVSAEDSALGSPQPSLMWELSPGFPMLFEMKWRSTTEMESMLCSWIQH

SEQ ID NO: 803565 - protein, 222 aa, Homo sapiens
MEIPPTNYPASRAALVAQNYINYQQGTPHRVFEVQKVKQASMEDIPGRGHKYRLKFAVEEIIQKQVKVNCTAEVLYPSTGQETAPEVNFTFEGETGKNPDEEDNTFYQRLKSMKEPLEAQNIPDNFGNVSPEMTLVLHLAWVACGYIIWQNSTEDTWYKMVKIQTVKQVQRNDDFIELDYTILLHNIASQEIIPWQMQVLWHPQYGTKVKHNSRLPKEVQLE

SEQ ID NO: 803566 - protein, 222 aa, Homo sapiens; identical to SEQ ID NO: 803565

SEQ ID NO: 803567 - protein, 226 aa, Homo sapiens
MEIPPTNYPASRAALVAQNYINYQQGTPHRVFEVQKVKQASMEDIPGRGHKYRLKFAVEEIIQKQVKVNCTAEVLYPSTGQETAPEVNFTFEGETGKNPDEEDNTFYQRLKSMKEPLEAQNIPDNFGNVSPEMTLVLHLAWVACGYIIWQNSTEDTWYKMVKIQTVKQVQRNDDFIELDYTILLHNIASQFHGIHDSTNSIFTFHLNTSTAIQTFSVPAFQEGKKS

SEQ ID NO: 803568 - protein, 178 aa, Homo sapiens
MEIPPTNYPASRAALVAQNYINYQQGTPHRVFEVQKVKQASMEDIPGRGHKYRLKFAVEEIIQKQVKVNCTAEVLYPSTGQETAPEVNFTFEGETGKNPDEEDNTFYQRLKSMKEPLEAQNIPDNFGNVSPEMTLVLHLAWVACGYIIWQNSTEDTWYKMVKIQTVKQVVSSFYKIHY

SEQ ID NO: 803569 - protein, 1513 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECKEGEGRTIIHCLNGGGRSGMFCAIGIVVEMVKRQNVVDVFHAVKTLRNSKPNMVEAPEQYRFCYDVALEYLESS

SEQ ID NO: 803570 - protein, 351 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAVSVLVVGNFCCCCSAAVCHSIRHLSRTQNPGQDHEGRLKGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQVRPSWQLS

SEQ ID NO: 803571 - protein, 144 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAASLGWRAHLLLGFAVQMETQWWPEGDGEDGKSDSHAPG

SEQ ID NO: 803572 - protein, 1513 aa, Homo sapiens; identical to SEQ ID NO: 803569

SEQ ID NO: 803573 - protein, 1109 aa, Homo sapiens
MTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECKEGEGRTIIHCLNGGGRSGMFCAIGIVVEMVKRQNVVDVFHAVKTLRNSKPNMVEAPEQYRFCYDVALEYLESS

SEQ ID NO: 803574 - protein, 1394 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSHAPRSCNFTSSACSL

SEQ ID NO: 803575 - protein, 813 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKPSAYALLHKQQLHENQYL

SEQ ID NO: 803576 - protein, 308 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQIFRL

SEQ ID NO: 803577 - protein, 118 aa, Homo sapiens
FFSFPQSAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAFFPHMKS

SEQ ID NO: 803578 - protein, 223 aa, Homo sapiens
RVRKLRTAALVHVLTQEFLILNLFLRDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAGL

SEQ ID NO: 803579 - protein, 1513 aa, Homo sapiens; identical to SEQ ID NO: 803569

SEQ ID NO: 803580 - protein, 1552 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAVSVLVVGNFCCCCSAAVCHSIRHLSRTQNPGQDHEGRLKGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECKEGEGRTIIHCLNGGGRSGMFCAIGIVVEMVKRQNVVDVFHAVKTLRNSKPNMVEAPEQYRFCYDVALEYLESS

SEQ ID NO: 803581 - protein, 934 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRCKFFIKILINDVTTHFTLNSTRYLLSNERE

SEQ ID NO: 803582 - protein, 812 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAFFPHMKS

SEQ ID NO: 803583 - protein, 775 aa, Homo sapiens
EHGELPPRPAGDAGDAFAPEVVWRPRRRKKGGRAAVLSPSSPREARPAPPSWISRRSPRQLFAKLLETSPKLGMDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPRTWHDRRLGGASVGLLPDPQHNKNET

SEQ ID NO: 803584 - protein, 966 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKASQASYFAVSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 803585 - protein, 126 aa, Homo sapiens
SSWSLGMRRGGTEGGGARNRSPCLPHRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 803586 - protein, 959 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 803587 - protein, 959 aa, Homo sapiens; identical to SEQ ID NO: 803586

SEQ ID NO: 803588 - protein, 714 aa, Homo sapiens
SGKVKRALSGRSGCTELLVRLDRVLVSPVSICFPHPRTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 803589 - protein, 932 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 803590 - protein, 404 aa, Homo sapiens
GEAPLWSSEQSLSLPLPVLPSSPGLPHPELSPSGSSMGRAAPVSPRPSGNSPWRFTLQPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 803591 - protein, 126 aa, Homo sapiens; identical to SEQ ID NO: 803585

SEQ ID NO: 803592 - protein, 165 aa, Homo sapiens
MRETDCRQKQNQNKPLPTSPKQPLKNCSEKQGISLCKVSCFFPRGCLRKTCHLEPCLHRRHGPACRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 803593 - protein, 891 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTQPQPWWPPWGQ

SEQ ID NO: 803594 - protein, 902 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGSPACLPLLRLPTHSPPPTLPHPFPTPCLTSHPPSLPPTHHCPT

SEQ ID NO: 803595 - protein, 932 aa, Homo sapiens; identical to SEQ ID NO: 803589

SEQ ID NO: 803596 - protein, 959 aa, Homo sapiens; identical to SEQ ID NO: 803586

SEQ ID NO: 803597 - protein, 959 aa, Homo sapiens; identical to SEQ ID NO: 803586

SEQ ID NO: 803598 - protein, 402 aa, Homo sapiens
PALLSAVVMATVASGGTATAGAAVTSFGAGQAGLNSRLSAHPTLPTASSVLATVGSGGASRPGACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 803599 - protein, 891 aa, Homo sapiens; identical to SEQ ID NO: 803593

SEQ ID NO: 803600 - protein, 165 aa, Homo sapiens; identical to SEQ ID NO: 803592

SEQ ID NO: 803601 - protein, 223 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDLVRLPP

SEQ ID NO: 803602 - protein, 369 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTRRQMPRQKELP

SEQ ID NO: 803603 - protein, 120 aa, Homo sapiens
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQK

SEQ ID NO: 803604 - protein, 132 aa, Homo sapiens
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKVSLCVGLGGDWA

SEQ ID NO: 803605 - protein, 120 aa, Homo sapiens; identical to SEQ ID NO: 803603

SEQ ID NO: 803606 - protein, 120 aa, Homo sapiens; identical to SEQ ID NO: 803603

SEQ ID NO: 803607 - protein, 113 aa, Homo sapiens
MISCDKMEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQK

SEQ ID NO: 803608 - protein, 139 aa, Homo sapiens
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKHPQCLTYSRCYVSAFGIHA

SEQ ID NO: 803609 - protein, 132 aa, Homo sapiens; identical to SEQ ID NO: 803604

SEQ ID NO: 803610 - protein, 172 aa, Homo sapiens
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTNKAWAKGDIQGAGAASRRAFLLGVLAVGLGVCTYAAALVTLAAYLASRDPP

SEQ ID NO: 803611 - protein, 120 aa, Homo sapiens; identical to SEQ ID NO: 803603

SEQ ID NO: 803612 - protein, 139 aa, Homo sapiens; identical to SEQ ID NO: 803608

SEQ ID NO: 803613 - protein, 172 aa, Homo sapiens; identical to SEQ ID NO: 803610

SEQ ID NO: 803614 - protein, 132 aa, Homo sapiens; identical to SEQ ID NO: 803604

SEQ ID NO: 803615 - protein, 759 aa, Homo sapiens
MTLRINHHIKEEVKGKYILYNKYLNIKHWDMTKTDLNTLKESLGWSDVQNYHACYKWRGVYMSCIACGAADDLNFQNENPFLRCRRINRMLSNESLHPPAFSRSNSEASVDSASMEDFWREIESIKDSSMGGQEEPPPAEVTPVDEGELEAEWLQDVGLSTLISGDEEEDGKALLSTLTRTQAAAVQKRYHTYTQTMRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 803616 - protein, 563 aa, Homo sapiens
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 803617 - protein, 563 aa, Homo sapiens; identical to SEQ ID NO: 803616

SEQ ID NO: 803618 - protein, 544 aa, Homo sapiens
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENSHGSSECIKIQNQRLYEIGGNIGEHCLDPDAYILDVYRINPQAEWVIKPQQSS

SEQ ID NO: 803619 - protein, 346 aa, Homo sapiens
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMESRWKTLYVNTLRYKVNKVRAE

SEQ ID NO: 803620 - protein, 195 aa, Homo sapiens
MPGERPTDATVIPSAKRERKAITLDLKLEVLRRFEAGEKLSQIAKALDLAISTVATIRDSKEKIKASSQIATPLRASRLTRHRSAVMESMEQLLSLWLEDQSQPNATLTRIVGEASAYADMRGLKKVMQQGAEIRMPVALRYSSSDRMHDVKYERSTQATMTDCECRTIQKAVVKLAFEHDYTWLTSRYIDAKCS

SEQ ID NO: 803621 - protein, 187 aa, Homo sapiens
MPGERPTDATVIPSAKRERKAITLDLKLEVLRRFEAGEKLSQIAKALDLAISTVATIRDSKEKIKASSQIATPLRASRLTRHRSAVMESMEQLLSLWLEDQSQPNATLSAAIVQEKAEFDDLQREHGEGSQTERFHASQGWLVRFKECHCLPHFKMNSAAPSNKDMYTEMLKSIIEEGEYTPQVSLT

SEQ ID NO: 803622 - protein, 169 aa, Homo sapiens
MPGERPTDATVIPSAKRERKAITLDLKLEVLRRFEAGEKLSQIAKALDLAISTVATIRDSKEKIKASSQIATPLRASRLTRHRSAVMESMEQLLSLWLEDQSQPNATLSEGSQTERFHASQGWLVRFKECHCLPHFKMNSAAPSNKDMYTEMLKSIIEEGEYTPQVSLT

SEQ ID NO: 803623 - protein, 187 aa, Homo sapiens; identical to SEQ ID NO: 803621

SEQ ID NO: 803624 - protein, 169 aa, Homo sapiens
MPGERPTDATVIPSAKRERKAITLDLKLEVLRRFEAGEKLSQIAKALDLAISTVATIRDSKESPSKCSDGEHGAAAELVAGRPEPAKCDLERRIVQEKAEFDDLQREHGEGSQTERFHASQGWLVRFKECHCLPHFKMNSAAPSNKDMYTEMLKSIIEEGEYTPQVSLT

SEQ ID NO: 803625 - protein, 132 aa, Homo sapiens [sequence omitted]

SEQ ID NO: 803626 - protein, 236 aa, Homo sapiens
SRPAPAESASPLTCRALPRALALVLAVLPPPGPPHRHSKASGLATALLPAAASSRYHIPRPRSRAARARACAMGERSQGPASAGRTRAGAAGARRRLGPRLGCPRRRLTVRGFDRQRSLALPRQLGPKGIASAFRLILNRASASTLISGVLHGKQLPKQHPPGPPSAALENRPWTFLPQCPPHGVPFVCLVGCSLEPQDPGRLYVPAAARPQHADFERYRETRAASSEWTVKQQLG

SEQ ID NO: 803627 - protein, 250 aa, Homo sapiens
GVVARLRNFGNCHFIHTRHCLGEGAVPGCRILALTSTQTTALAAVWGRLLRGSPRLSDPATGNGAPFGEEPQPGVGTHRLSDSSNTDRSSRAEGISFRRSHYSPREKAAKLGSPGCAPPALLDPRACTGCTLRTSCARSGAMQHPPCEPGNCLSLKEKKITEGSGGVCWGGETDASNPAPALTACCAAEREANVEQGLAGRLLLCNYERRLVRRCKIAGRGRAPLGTRPLDVSSFKLKEEGRPPCLKINK

SEQ ID NO: 803628 - protein, 219 aa, Homo sapiens
TAGAWAAAQTSSRCPPPGGSSRGRRSRSHLRPGAPFGEEPQPGVGTHRLSDSSNTDRSSRAEGISFRRSHYSPREKAAKLGSPGCAPPALLDPRACTGCTLRTSCARSGAMQHPPCEPGNCLSLKEKKITEGSGGVCWGGETDASNPAPALTACCAAEREANVEQGLAGRLLLCNYERRLVRRCKIAGRGRAPLGTRPLDVSSFKLKEEGRPPCLKINK

SEQ ID NO: 803629 - protein, 254 aa, Homo sapiens [sequence omitted]

SEQ ID NO: 803630 - protein, 254 aa, Homo sapiens [sequence omitted]

SEQ ID NO: 803631 - protein, 213 aa, Homo sapiens
MQLVQQRSQIQTLQKKVVNLETALSYMTKEFESEVLKLQQHAMIENQAGQVEIDKLQHLLQMKDREMNRVKKLAKNILDERTEVERFFLDALHQVKQQILISRKHYKQIAQAAFNLKMRAACTGRTEYPKIRTFDGREHSTNSVNQDLLEAEKWTHIEGNVDIGDLTWEQKEKVLRLLFAKMNGCPSRKYNQSSRPPVPDYVVSDSGETKEFG

SEQ ID NO: 803632 - protein, 213 aa, Homo sapiens; identical to SEQ ID NO: 803631

SEQ ID NO: 803633 - protein, 213 aa, Homo sapiens; identical to SEQ ID NO: 803631

SEQ ID NO: 803634 - protein, 221 aa, Homo sapiens
MSAHMSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQVDNFLDLEDLDMDEEIKPQMSEDLLLLPGEVEQDVSTSIPSCIPFVAQPPTCEVKPKPSVKRMDKQTEEILGDEVQLFSLDEEFDYDNVMLTSKFSPAEIENIKELCKQQKRKDTSPDLEKSCD

SEQ ID NO: 803635 - protein, 221 aa, Homo sapiens; identical to SEQ ID NO: 803634

SEQ ID NO: 803636 - protein, 221 aa, Homo sapiens; identical to SEQ ID NO: 803634

SEQ ID NO: 803637 - protein, 217 aa, Homo sapiens [sequence omitted]

SEQ ID NO: 803638 - protein, 221 aa, Homo sapiens; identical to SEQ ID NO: 803634

SEQ ID NO: 803639 - protein, 105 aa, Homo sapiens
MSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQICCCFQEKWSRM

SEQ ID NO: 803640 - protein, 203 aa, Homo sapiens
MSAHMSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQVDNFLDLEDLDMDEEIKPQMSEDLLLLPGEVEQDVSTSIPSCIPFVAQPPTCEVKPKPIFSLDEEFDYDNVMLTSKFSPAEIENIKELCKQQKRKDTSPDLEKSCD

SEQ ID NO: 803641 - protein, 147 aa, Homo sapiens
MSAHMSGLEIMDEDQLIKDVLDKFLNCHEQTYDEEFLNTFTHLSQDLLLLPGEVEQDVSTSIPSCIPFVAQPPTCEVKPKPSVKRMDKQTEEILGDEVQLFSLDEEFDYDNVMLTSKFSPAEIENIKELCKQQKRKDTSPDLEKSCD

SEQ ID NO: 803642 - protein, 147 aa, Homo sapiens; identical to SEQ ID NO: 803641

SEQ ID NO: 803643 - protein, 1881 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDIIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 803644 - protein, 1880 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDIIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 803645 - protein, 1719 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDIIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 803646 - protein, 1856 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDIIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEDHTSTPNP

SEQ ID NO: 803647 - protein, 69 aa, Homo sapiens
DEQGNIVTKKIIRKVVRQIDLSSADAAQEHEEVLCAKAHPPGAGQGAGGERGPLLRLAWLHAPAASRSR

SEQ ID NO: 803648 - protein, 1880 aa, Homo sapiens; identical to SEQ ID NO: 803644

SEQ ID NO: 803649 - protein, 155 aa, Homo sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 803650 - protein, 156 aa, Homo sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 803651 - protein, 133 aa, Homo sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKVELRGSGLQPDLIEGRKGAQIVKRASLKRGKQ

SEQ ID NO: 803652 - protein, 131 aa, Homo sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEDHTSTPNP

SEQ ID NO: 803653 - protein, 1040 aa, Homo sapiens
MVRWGPFLWWRSPWMQPRTAAVRNQWVLDQPTVFNSWPRASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDIIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 803654 - protein, 109 aa, Homo sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKDHTSTPNP

SEQ ID NO: 803655 - protein, 1040 aa, Homo sapiens; identical to SEQ ID NO: 803653

SEQ ID NO: 803656 - protein, 675 aa, Homo sapiens
MVRWGPFLWWRSPWMQPRTAAVRNQWVLDQPTVFNSWPRASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDIIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVLQEEEPFIWEGDSEESRSVCRLSGFKLRLCRPEPS

SEQ ID NO: 803657 - protein, 110 aa, Homo sapiens
IIRKVVRQIDLSSADAAQEHEEVTVEGPLEDPSELEVDIDYFMKHSKVLRRPRPWGTQRHHCCLALPGRLHDTSLHSPLYELSLQSLFSLVGSVSAPPCGLLSIFCLCSA

SEQ ID NO: 803658 - protein, 291 aa, Homo sapiens
ARLGLPPWGAGGGVRDVETRGPGSRAARGPRVGMHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQDDLIRAIKKLKALGTGFGIIPVGGTYLIQSVPAELNMDHTVVLQLAEKNGYVTVSEIKASLKWETERARQVLEHLLKEGLAWLDLQAPGEAHYWLPALFTDLYSQEITAEEAREALP

SEQ ID NO: 803659 - protein, 98 aa, Homo sapiens
MDHTVVLQLAEKNGYVTVSEIKASLKWETERARQVLEHLLKEGLAWLDLQAPGEAHYWLPALFTDLYSQVYLPPPPPPCLLLCALPHAVRGGLLWPPQ

SEQ ID NO: 803660 - protein, 291 aa, Homo sapiens; identical to SEQ ID NO: 803658

SEQ ID NO: 803661 - protein, 291 aa, Homo sapiens; identical to SEQ ID NO: 803658

SEQ ID NO: 803662 - protein, 291 aa, Homo sapiens; identical to SEQ ID NO: 803658

SEQ ID NO: 803663 - protein, 169 aa, Homo sapiens
MLGVGDFYYELGVQIIEVCLALKHRNGGLITLEELHQQVLKGRGKFAQDVSQDDLIRAIKKLKALGTGFGIIPVGGTYLIQSVPAELNMDHTVVLQLAEKNGYVTVSEIKASLKWETERARQVLEHLLKEGLAWLDLQAPGEAHYWLPALFTDLYSQEITAEEAREALP

SEQ ID NO: 803664 - protein, 317 aa, Homo sapiens
ARLGLPPWGAGGGVRDVETRGPGSRAARGPRVGMHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGVYRPLRTWRHLSCFMQLNPWQVSMAKGLITLEELHQQVLKGRGKFAQDVSQDDLIRAIKKLKALGTGFGIIPVGGTYLIQSVPAELNMDHTVVLQLAEKNGYVTVSEIKASLKWETERARQVLEHLLKEGLAWLDLQAPGEAHYWLPALFTDLYSQEITAEEAREALP

SEQ ID NO: 803665 - protein, 154 aa, Homo sapiens
MQLNPWQVSMAKGLITLEELHQQVLKGRGKFAQDVSQDDLIRAIKKLKALGTGFGIIPVGGTYLIQSVPAELNMDHTVVLQLAEKNGYVTVSEIKASLKWETERARQVLEHLLKEGLAWLDLQAPGEAHYWLPALFTDLYSQEITAEEAREALP

SEQ ID NO: 803666 - protein, 174 aa, Homo sapiens
ARLGLPPWGAGGGVRDVETRGPGSRAARGPRVGMHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQ

SEQ ID NO: 803667 - protein, 131 aa, Homo sapiens
PSRLLLLNSRPVDQDDLIRAIKKLKALGTGFGIIPVGGTYLIQSVPAELNMDHTVVLQLAEKNGYVTVSEIKASLKWETERARQVLEHLLKEGLAWLDLQAPGEAHYWLPALFTDLYSQEITAEEAREALP

SEQ ID NO: 803668 - protein, 114 aa, Homo sapiens
ARLGLPPWGAGGGVRDVETRGPGSRAARGPRVGMHRRGVGAGAIAKKKLAEAKYKERGTVLAEDQLAQMSKQLDMFKTNLEEFASKHKQEIRKNPEFRVQFQDMCATIGVDPLA

SEQ ID NO: 803669 - protein, 174 aa, Homo sapiens; identical to SEQ ID NO: 803666

SEQ ID NO: 803670 - protein, 153 aa, Homo sapiens
ARLGLPPWGAGGGVRDVETRGPGSRAARGPRVGMHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGEGG

SEQ ID NO: 803671 - protein, 153 aa, Homo sapiens; identical to SEQ ID NO: 803670

SEQ ID NO: 803672 - protein, 512 aa, Homo sapiens
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPQRLSSAHSMSDLSGSHMSSEKLKAGTIGQTHLLGHQLDSFGTVPESGSLKSPHRRTLSFDTSKMNQPDSIVDEGELCFGRQNDPFTNVTASLPQKFATLPRKKNPFEESSETWDSSMNLFSKPIEIRKENKREKREKVSLFERVTGKKDSRRSDKLNNGGSDSPCDLKSPNAFSENRQDYFDYESTNPFTAKFRASNIMPSSSFHMSPTSNEDLRKIPDSNPFDATAGYRSLTYEEVLQELVKHKELLRRKDTHIRELEDYIDNLLVRVMEETPSILRVPYEPSRKAGKFSNS

SEQ ID NO: 803673 - protein, 494 aa, Homo sapiens
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPNLSGSHMSSEKLKAGTIGQTHLLGHQLDSFGTVPESGSLKSPHRRTLSFDTSKMNQPDSIVDEGELCFGRQNDPFTNVTASLPQKFATLPRKKNPFEESSETWDSSMNLFSKPIEIRKENKREKREKVSLFERVTGKKDSRRSDKLNNGGSDSPCDLKSPNAFSENRQDYFDYESTNPFTAKFRASNIMPSSSFHMSPTSNEDLRKIPDSNPFDATAGYRSLTYEEVLQELVKHKELLRRKDTHIRELEDYIDNLLVRVMEETPSILRVPYEPSRKAGKFSNS

SEQ ID NO: 803674 - protein, 512 aa, Homo sapiens; identical to SEQ ID NO: 803672

SEQ ID NO: 803675 - protein, 270 aa, Homo sapiens
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPREFARLQVRFLVPSFGTGVSMLSSPPIICEPQEDTPQCFYNPSVVWPPSGR

SEQ ID NO: 803676 - protein, 422 aa, Homo sapiens
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPQRLSSAHSMSDLSGSHMSSEKLKAGTIGQTHLLGHQLDSFGTVPESGSLKSPHRRTLSFDTSKMNQPDSIVDEGELCFGRQNDPFTNVTASLPQKFATLPRKKNPFEESSETWDSSMNLFSKPIEIRKENKREKREKVSLFERVTGKKDSRRSDKLNNGGSDSPCDLKSPNAFSENRQDYFDYESTNPFTAKFRASNIMPSSR

SEQ ID NO: 803677 - protein, 119 aa, Homo sapiens
MRPRAPRASSPNLPADDMRHRPGDPGSGISRLHGRRTREDTPQCACATLSRPLKKAMWPLHQSESCFFPGPALFPDFRRLAGRKTTLNYRARRLPETSGYCSPKGSERQEHVLVKSSLE

SEQ ID NO: 803678 - protein, 84 aa, Homo sapiens
SEKSGKHVSAEEKEKDKSKLWEESTAQVKDKKAGLPGLEEGGKDSLPLAYVLALGAPTMNFMVDETAAINSNKESQQLVQKTYT

SEQ ID NO: 803679 - protein, 239 aa, Homo sapiens
HIKPEDFLFAYTILRSVPNKLGGVLALLLSILILAKNLHNRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEVSISRGGAGSWKLLISFSFLFFLRQSR

SEQ ID NO: 803680 - protein, 3347 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803681 - protein, 3347 aa, Homo sapiens; identical to SEQ ID NO: 803680

SEQ ID NO: 803682 - protein, 3347 aa, Homo sapiens; identical to SEQ ID NO: 803680

SEQ ID NO: 803683 - protein, 3347 aa, Homo sapiens; identical to SEQ ID NO: 803680

SEQ ID NO: 803684 - protein, 3347 aa, Homo sapiens; identical to SEQ ID NO: 803680

SEQ ID NO: 803685 - protein, 3310 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALFDQCDSTIGTCCPSGSWTSLLGTIWCFPVSISLDSRFGHSSIPVFISDTWSPSVVGSHLFTCSRVELNRGPSMLTCPGASFGSGQSFSVSTKSTPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803686 - protein, 2798 aa, Homo sapiens
MPRLSRGSRLTLLNPSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSDDSTIGTCCPSGSWTSLLGTIWCFPVSISLDSRFGHSSIPVFISDTWSPSVVGSHLFTCSRVELNRGPSMLTCPGASFGSGQSFSVSTKSTPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803687 - protein, 1649 aa, Homo sapiens
MLTCPGASFGSGQSFSVSTKSTPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803688 - protein, 1762 aa, Homo sapiens
RNQINNNLFFCSPTFFSGPSLGSTHHPHLSPLDCFCFGPSSVDQCDSTIGTCCPSGSWTSLLGTIWCFPVSISLDSRFGHSSIPVFISDTWSPSVVGSHLFTCSRVELNRGPSMLTCPGASFGSGQSFSVSTKSTPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803689 - protein, 1548 aa, Homo sapiens
MMLELMTMSELERVPGGSPFPKRVSEMEMSLQEWVLKLGLGPVSAWKPGSGEVTEPGLVAEFELMMEPTPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803690 - protein, 1347 aa, Homo sapiens
MIPDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803691 - protein, 1365 aa, Homo sapiens
MSGFDVDSEGADYFLFFSHPQDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803692 - protein, 1106 aa, Homo sapiens
HIKPEDFLFAYTILRSVPNKLGGVLALLLSILILAKNLHNRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803693 - protein, 823 aa, Homo sapiens
GEVTLAGSLRHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 803694 - protein, 2590 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAQFAQTCQLL

SEQ ID NO: 803695 - protein, 1884 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALFDQCDSTIGTCCPSGSWTSLLGTIWCFPVSISLDSRFGHSSIPVFISDTWSPSVVGSHLFTCSRVELNRGPSMLTCPGASFGSGQSFSVSTKSSSSSGFPSGSSIFCISGSSHPSGSYGGSTDSNSGSFSSSSSGSSSGPGTIARCCSCPGFITDSGSSYGSIVYSRNLFSLSFTGTSSNPCVGSIINSNYATSPGSVTSPEPGFYADTGPSPSFSTHSWRLISISDTLFGNGEPPGTLSNSDIVINSSIIPGTNSSPDTVFGTRTTAILTHWASLFSNADSRLLSPASACVLYS

SEQ ID NO: 803696 - protein, 108 aa, Homo sapiens
MEDEEKAVEILGNTEAAHPPSPIRCCWLRLRCLAATSIICGCSCLGVMALVFAIKAEERHKAGRSEEAVRWGARARKLILASFAVWLAVLILGPLLLWLLSYAIAQAE

SEQ ID NO: 803697 - protein, 1574 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLKSTSPGPAHASLQPLQAQLLHLGGPSRPSLCLPSASTVPTSASQQILTPSIYLTVT

SEQ ID NO: 803698 - protein, 406 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVGNLKHQSRLVGPVKA

SEQ ID NO: 803699 - protein, 150 aa, Homo sapiens
ELSMEELLQQYAGAYAPGSGSSEDEDEDEVDANSSDCEPEGPVEAEEPPQEDSSSQSGEYVVMKQELGRVAIGRAGMMSSKPWSYPLDSVEDRSEDEEDEHSEEEETSGSSASEESESEESEDAQSQSQADEEEEDDDFGVEYLLARDEE

SEQ ID NO: 803700 - protein, 2089 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQRNVVHLVSAGGQHHLISQPAHVALIQAVAPTPGPTPVSVLPSSTPSTTPAPTGLSLPLAANQVPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLVSFTSSRGNRKLSFFGVLVGWMEQ

SEQ ID NO: 803701 - protein, 3100 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEKGERQVHSLTYHWVLDAARTFGAGPSPPLRVRRDFLQRVFRLWFRPLVPVPCAVDHGIIPGLPVFPKDEALTHPDTLRLVAPPTCKRRHTRHGMTSKHIANTQPSHKQGPHETHRTDHTPHSTQSPPSGTLRNTKDLDTERHGITKPKAPHICTERTLTSEHTHRNTLPTPCHTRKPLHSGQHRHTQGRKQTDSDTTKKPRANKEGTRDYKTQGENTNQKRKPTPNKGPTEPPPDHRSKGDHNNNMHDKPRGKKNETKQTQNQHKQRQKNADKNRPQPNNKQKRHAGKDTTRQPPNERTQTHPDTNTHDSQHTTTHITTILHFAHYKIIFYYQYNYHSHNPSSKNQELTSIKQLNLHSKTHSQTTTAKYNKQITTTNHFNPSHHTPTPHTTP

SEQ ID NO: 803702 - protein, 1855 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALFDQCDSTIGTCCPSGSWTSLLGTIWCFPVSISLDSRFGHSSIPVFISDTWSPSVVGSHLFTCSRVELNRGPSMLTCPGASFGSGQSFSVSTKSSSSSGFPSGSSIFCISGSSHPSGSYGGSTDSNSGSFSSSSSGSSSGPGTIARCCSCPGFITDSGSSYGSIVYSRNLFSLSFTGTSSNPCVGSIINSNYATSPGSVTSPEPGFYADTGPSPSFSTHSWRLISISDTLFGNGEPPGTLSNSDIWLSWKWGSSQSPSPSPHVAGQC

SEQ ID NO: 803703 - protein, 1390 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPCKFPGLCGEGLEMGGKLRTMRASNFRQLGQA

SEQ ID NO: 803704 - protein, 1125 aa, Homo sapiens
AAETAAAILVRPRERQRRFAGSSVCPFSHPPSASVCCAKRQWRQGGGSSRSLQGSLKAAKAVAKRGPSPLLGGRGGGAHAPEDAGVIPFSTAAPWKCRLSQGVWSQLTQVLQRLVDLSGGWDALVGPGPWKAGPGGLVAQNEASSQHALQPDASPSASSTGDNNPVILQASKGEPGSGTMQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQVSMIPLI

SEQ ID NO: 803705 - protein, 85 aa, Homo sapiens
LRPFPFLSFAIQIKPPPSAVTQRNKQPWHPDEDDEEFTANEEEGQGCSVCPIAPYPLNELSGPNLSGFLICFIWTVSCASSLYPY

SEQ ID NO: 803706 - protein, 99 aa, Homo sapiens
LVHASAPPGRGTLLGRPRVPPRCSVPSSQLEPSSSPAVLPQRLAAGRRQTKGLEPRLTLAFVPRPSSAAAVRGRQPLPQHVWAKPPPFRLRWRERYQKE

SEQ ID NO: 803707 - protein, 99 aa, Homo sapiens; identical to SEQ ID NO: 803706

SEQ ID NO: 803708 - protein, 134 aa, Homo sapiens
ILACKDFLLSPLLPNSCEGLRHSSGGGRKSERAKNFGIEVAKASPHVLQEKVAFNCGKDTRGTGEGESSGKNEPEADKATARPAESCLLGLVVRGAPGAGWLRRLGRCAGPTPAGGVTVWNPPGSASACFLRLV

SEQ ID NO: 803709 - protein, 134 aa, Homo sapiens; identical to SEQ ID NO: 803708

SEQ ID NO: 803710 - protein, 70 aa, Homo sapiens
VNRAGVAASACALPSGGREAEVQAGRALVTLRTSRTPDDWAPGPDGGWRASAAQLPPLNRDTLQECAEWS

SEQ ID NO: 803711 - protein, 175 aa, Homo sapiens
MAEVHVIGQIMGASGFSESSLFCKWGIHTGAAWKLLSGVREGQTQVDTPQIGDMAYWSHPIDLHFATKGLQGWPRLHFQVWSQDSFGRCQLAGYGFCHVPSSPGTHQLACPTWRPLGSWREQLARAFVGGGPQLLHGDTIYSGADRYRLHTAAGGTVHLEIGLLLRNFDRYGVEC

SEQ ID NO: 803712 - protein, 255 aa, Homo sapiens
GGDGDVLGLARHYLGSLITGMVCGVGGPTDGSVKVPWSRHSSLDPSRLGSHRMLDSCCVLYPIFLAVEAAPIVSGLTSLVHNQLTDVQSHALSTEKSSLFCKVRGHSTTRAAWKLLSGVREGQTQVDTPQIGDMAYWSHPIDLHFATKGLQGWPRLHFQVWSQDSFGRCQLAGYGFCHVPSSPGTHQLACPTWRPLGSWREQLARAFVGGGPQLLHGDTIYSGADRYRLHTAAGGTVHLEIGLLLRNFDRYGVEC

SEQ ID NO: 803713 - protein, 75 aa, Homo sapiens
RGGACCCPSNNHGNQDERGRGSIAAYISRSQAGPGRGASQAWSAPAEKRSSQAHELQPRLPLSPLLTVKCAKGHG

SEQ ID NO: 803714 - protein, 102 aa, Homo sapiens
REGAWLGTMAAGGKVGLEVCGEEAAEGQQGCAFCCAPLRGPEPVFELLLSGGSGSFFRLCFPFLQPADRVCLEVESPGRIKDTAFVPFKEVMFSEKHRPGPR

SEQ ID NO: 803715 - protein, 72 aa, Homo sapiens
LWLTIVSCFCPAYPINIVALVFSIMSLNSYNDGDYEGARRLGRNAKWVAIASIIIGLLIIGISCAVHFTRNA

SEQ ID NO: 803716 - protein, 391 aa, Homo sapiens
RAAPPAAGAAGALVELRRARSGGRGGGWHWLRTLPGQGGGSSREGDVERPRGAARGRLAAGGEARAAQQPGAPTELDPQSRAAAAAVPGRMLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEARENGEEAKELPGETLESKNTQNDFEVHIVQVENDEI

SEQ ID NO: 803717 - protein, 296 aa, Homo sapiens
MTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEARENGEEAKELPGETLESKNTQNDFEVHIVQVENDEI

SEQ ID NO: 803718 - protein, 147 aa, Homo sapiens
RAAPPAAGAAGALVELRRARSGGRGGGWHWLRTLPGQGGGSSREGDVERPRGAARGRLAAGGEARAAQQPGAPTELDPQSRAAAAAVPGRMLPLTMTVLILLLLPTGQAAPKDGVTRPDSEVQHQLLPNPFQPGQEQLGSPLPLCPP

SEQ ID NO: 803719 - protein, 506 aa, Homo sapiens
RAAPPAAGAAGALVELRRARSGGRGGGWHWLRTLPGQGGGSSREGDVERPRGAARGRLAAGGEARAAHSQERPRSWTPRAARRRSSFTPEASEITNPLGETNNSRRTALRAVTLTAKVRSCIPEPARPQTHQKEETSNASEHQKEQTPDTPPLGTVTLNREGRGFILEVSETKNPPIPDTLGLQVLNHNTWLSLFLIEIAKVPGRMLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEARENGEEAKELPGETLESKNTQNDFEVHIVQVENDEI

SEQ ID NO: 803720 - protein, 460 aa, Homo sapiens
APRHASLVPGSESLARPAARLATAPPRTHMEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGALFSAVACVNSLAMLTASGIFNSLYPATLNFMKGFPFLLGAGLLLIPAVLIGMLEKADPHLEFQQFPQSP

SEQ ID NO: 803721 - protein, 438 aa, Homo sapiens
APRHASLVPGSESLARPAARLATAPPRTHMEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGKVCGLRDSLSQRHWVRTGGRPLTAPRCGSFLCLWKHSYAPSLHWRTDN

SEQ ID NO: 803722 - protein, 371 aa, Homo sapiens [sequence omitted]

SEQ ID NO: 803723 - protein, 488 aa, Homo sapiens
APRHASLVPGSESLARPAARLATAPPRTHMEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGYGLLFLSLVITPVIRAKLSKLVRETEQGALFSAVACVNSLAMLTASGIFNSLYPATLNFMKGFPFLLGAGLLLIPAVLIGMLEKADPHLEFQQFPQSP

SEQ ID NO: 803724 - protein, 353 aa, Homo sapiens
MNVGGFLVGLFSSTLLGAWSDSVGRRPVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGYGLLFLSLVITPVIRAKLSKLVRETEQGALFSAVACVNSLAMLTASGIFNSLYPATLNFMKGFPFLLGAGLLLIPAVLIGMLEKADPHLEFQQFPQSP

SEQ ID NO: 803725 - protein, 253 aa, Homo sapiens
MELEQREGTMAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEDEGSQGTDAPTPGNAENEPPEKETLSPPRRTPAPPEPGSPAPGEGPSGRKRRRVPRDGRRAGNALTPELAPVQIKVEEDFGFEADEALDSSWVSRGPDKLLPYPTLASPASD

SEQ ID NO: 803726 - protein, 194 aa, Homo sapiens
MELEQREGTMAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEMRAAGTDVPPRKGKMAPEEDCVPKGLCQNGDTREAKAKHDRGARKRTQTRIES

SEQ ID NO: 803727 - protein, 133 aa, Homo sapiens
MRVLDSYGDDYRASQFTIVLEDEGSQGTDAPTPGNAENEPPEKETLSPPRRTPAPPEPGSPAPGEGPSGRKRRRVPRDGRRAGNALTPELAPVQIKVEEDFGFEADEALDSSWVSRGPDKLLPYPTLASPASD

SEQ ID NO: 803728 - protein, 202 aa, Homo sapiens
MELEQREGTMAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEDEGSQGTDAPTPGNAENEPPEKETLSPPRRTPAPPEPGSPVPCWGLNRHGKRLVSKDASRS

SEQ ID NO: 803729 - protein, 194 aa, Homo sapiens
MELEQREGTMAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERSHRDLEPESEPQLESETAGKWVLCNYDFQARNSSELSVKQRDVLEVLDDSRKWWKVRDPAGQEGSALQHPTPNPDKM

SEQ ID NO: 803730 - protein, 107 aa, Homo sapiens
MELEQREGTMAAVGFEEFSAPPGSELALPPLFGGHILESELETEVEFVSGGLGGSGLRERDEEEEAARGRRRRQRELNRRKYQPPVRGPVGGRGGECHGMDAEQEMR

SEQ ID NO: 803731 - protein, 244 aa, Homo sapiens
MAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEDEGSQGTDAPTPGNAENEPPEKETLSPPRRTPAPPEPGSPAPGEGPSGRKRRRVPRDGRRAGNALTPELAPVQIKVEEDFGFEADEALDSSWVSRGPDKLLPYPTLASPASD

SEQ ID NO: 803732 - protein, 253 aa, Homo sapiens; identical to SEQ ID NO: 803725

SEQ ID NO: 803733 - protein, 253 aa, Homo sapiens; identical to SEQ ID NO: 803725

SEQ ID NO: 803734 - protein, 48 aa, Homo sapiens
MLMGYAGQKHETMVSRMVVLGLREVFTSCRGYGARIGKSCAELSQYEL

SEQ ID NO: 803735 - protein, 101 aa, Homo sapiens
LSASPTDVQSKTQRSWRIFLTSHSKGMEDSGQEYTILSFQHVTQQNKRRNHNWSMTVTVISFLLPVAGVCVSLQLNPGQGDPRTAEEACLHMSPRTSPAIM

SEQ ID NO: 803736 - protein, 169 aa, Homo sapiens
AAASPEPQGRPRSAASRPPRSAAGPGDADTKGTRVTLPGPARPRCAALTPPPGTGCGVPGARSLPPAPPRARAARTARTAMPALPPPACREPARGEAAARAGRERAQRPGTREARPRPRPRAEPHSAPCRPPAPARGPEPPRRPQDRLRHEEGLRRPPVHANMKMLFLL

SEQ ID NO: 803737 - protein, 266 aa, Homo sapiens
GYCGSWVFTCGALRQLSGGRDLSRGARMGNSALRAHVETAQKTGVFQLKDRGLTEFPADLQKLTSNLRTIDLSNNKIESLPPLLIGKFTLLKSLSLNNNKLTVLPDEICNLKKLETLSLNNNHLRELPSTFGQLSALKTLSLSGNQLGALPPQLCSLRHLDVMDLSKNQIRSIPDSVGELQVIELNLNQNQISQISVKISCCPRLKILRLEENCLELSMLPQSILSDSQICLLAVEGNLFEIKKLRELEGYDKYMERFTATKKKFA

SEQ ID NO: 803738 - protein, 125 aa, Homo sapiens [sequence omitted]

SEQ ID NO: 803739 - protein, 125 aa, Homo sapiens [sequence omitted]

SEQ ID NO: 803740 - protein, 125 aa, Homo sapiens [sequence omitted]

SEQ ID NO: 803741 - protein, 113 aa, Homo sapiens
ARARAARDLGLGMWYRLLAAAGSRAVARPLALLWRCGGPGGGRTAKTSARALGKARQWLWPVRMCGVALQKKLGKLIWPPVPVLPGDPRSEADSAGKTDVIFLVAVFKTTQRV

SEQ ID NO: 803742 - protein, 113 aa, Homo sapiens; identical to SEQ ID NO: 803741

SEQ ID NO: 803743 - protein, 122 aa, Homo sapiens
MEFVNFLKNPKQYQDLGAKIPKGAMLTGPPGTGKTLLAKATAGEATVPFITVNGSEFLEMFIGVGPARGSTLPPTSWCWLAPTALTSWTRPSCGLAGFIARFTLVPLTLKAGPPSLRSTCAH

SEQ ID NO: 803744 - protein, 122 aa, Homo sapiens; identical to SEQ ID NO: 803743

SEQ ID NO: 803745 - protein, 95 aa, Homo sapiens
VEVGGSQGEGRSSIFKVHLRPLKLDKSLNKDTLARKLAVLTPGFPDVCLHTKVKKLECYQDCFLLPIDGDDSALPLNRDDFDDSAPQQGLLSTTP

SEQ ID NO: 803746 - protein, 196 aa, Homo sapiens
RDAARVSGNMAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMG

SEQ ID NO: 803747 - protein, 429 aa, Homo sapiens
RDAARVSGNMAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGCVDAWEPKVLRAGMGAHFRMPIINNLEWETVPNYLPPDTRVYVADNCGLYAQAEMSNKASDHGWVCDQRVMKFHKYEEEEDVETGASQDWLPHVEVQSYDSDWTEAPAAVVIGGETYGVSLESLQLAESTGGKRLLIPVVPGVDSLNSAMAASILLFEGKRQLRGRAEDLSRDRSYH

SEQ ID NO: 803748 - protein, 259 aa, Homo sapiens
RDAARVSGNMAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGKDIKGQA

SEQ ID NO: 803749 - protein, 196 aa, Homo sapiens; identical to SEQ ID NO: 803746

SEQ ID NO: 803750 - protein, 429 aa, Homo sapiens; identical to SEQ ID NO: 803747

SEQ ID NO: 803751 - protein, 289 aa, Homo sapiens
LRLVRGCGVEFGRGFDRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGCVDAWEPKVLRAGMGAHFRMPIINNLEWETVPNYLPPDTRVYVADNCGLYAQAEMSNKASDHGWVCDQRVMKFHKYEEEEDVETGASQDWLPHVEVQSYDSDWTEAPAAVVIGGETYGVSLESLQLAESTGGKRLLIPVVPGVDSLNSAMAASILLFEGKRQLRGRAEDLSRDRSYH

SEQ ID NO: 803752 - protein, 224 aa, Homo sapiens
MTYPKTQLQHSLPLLLICDNLRDPGNLGTILRSAAGAGCSKVLLTKGCVDAWEPKVLRAGMGAHFRMPIINNLEWETVPNYLPPDTRVYVADNCGLYAQAEMSNKASDHGWVCDQRVMKFHKYEEEEDVETGASQDWLPHVEVQSYDSDWTEAPAAVVIGGETYGVSLESLQLAESTGGKRLLIPVVPGVDSLNSAMAASILLFEGKRQLRGRAEDLSRDRSYH

SEQ ID NO: 803753 - protein, 224 aa, Homo sapiens; identical to SEQ ID NO: 803752

SEQ ID NO: 803754 - protein, 195 aa, Homo sapiens
MSRPLGQSRRRPPDPIARWQRSRRLQAEGPAGVPLGEPVFPQGLLQAQPALGVVLAQESLGTAWVTERDSVSKKKKKAWVTMSLFQEWFLHFCSTVEGAAPSTTFPTRGCPSWTALPATLGVETESGSVAQAGVRWRDLGSLQPPPPGFTPFSCLSLPGSWDYRRPPPRPANFFVFLVETGFHRVSQNGLGLLTP

SEQ ID NO: 803755 - protein, 198 aa, Homo sapiens
MSRWPCQRLTWQRRSVTQASGASGASLCASRLPRDKTAPKAKEAPAPPKAEAKAKALKAKKAVLKGVRSHTAKKKIRMSLTFRRPKTLRLRRQPRYPRKSTPRRNKLGHYAIIKFPLTTESAVKKIEENNTLVFTVDVKANKHQIRQAVKKLYDSDVAKVTTLICPDKEKKAYVRLAPDYDAFDVVTKLGSPKLSPAG

SEQ ID NO: 803756 - protein, 195 aa, Homo sapiens; identical to SEQ ID NO: 803754

SEQ ID NO: 803757 - protein, 139 aa, Homo sapiens
MLLATLSSEMTLCPSRPVVGELVRKHTWALPTRHPSPGVGYPHGCRHPLARPGCSFSLSLLVSSPLPAFSALSSCFLLFSPGLLPCPQTFFFPRIWAHSKERVAFGHKALDPTMEDWGVPDAPQKEACRDSTWESPMAL

SEQ ID NO: 803758 - protein, 133 aa, Homo sapiens
MSRPLGQSRRRPPDPIARWQRSRRLQAEGPAGVPLGEPVFPQGLLQAQPALGVVLAQESLGTAWVTERDSVSKKKKKAWVTMSLFQEWFLHFCSTVEGAAPSTTFPTRGCPSWTALPATLGVETERDSVSKKK

SEQ ID NO: 803759 - protein, 195 aa, Homo sapiens; identical to SEQ ID NO: 803754

SEQ ID NO: 803760 - protein, 369 aa, Homo sapiens
RLRGGVLGRQPFLRRTAGRSDVLPVAGGEVRALQEGGCGDKMKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSL

SEQ ID NO: 803761 - protein, 375 aa, Homo sapiens
GRVGRTRGSRDRVGSTHASGRTAGRSDVLPVAGGEVRALQEGGCGDKMKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSL

SEQ ID NO: 803762 - protein, 210 aa, Homo sapiens
MEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSL

SEQ ID NO: 803763 - protein, 276 aa, Homo sapiens
GRVGRTRGSRDRVGSTHASGRTAGRSDVLPVAGGEVRALQEGAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKK

SEQ ID NO: 803764 - protein, 207 aa, Homo sapiens
ALTVGGGKTLQQEEKQLQPCMQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGKELKPRMFES

SEQ ID NO: 803765 - protein, 487 aa, Homo sapiens
ALTVGGGKTLQQEEKQLQPCMQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQVSSSRQSLPIKAILKSLPVWAISIGSFTFFWSHNIMTLYTPMFINSMLHVNIKENGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 803766 - protein, 487 aa, Homo sapiens; identical to SEQ ID NO: 803765

SEQ ID NO: 803767 - protein, 487 aa, Homo sapiens; identical to SEQ ID NO: 803765

SEQ ID NO: 803768 - protein, 81 aa, Homo sapiens
NPMYNWSPDIQGIILSSTSYGVIIIQVPVGYFSGIYSTKKMIGFALCLSSVLSLLIPPAAGIGVAWVVVCRAVQGAAQVLK

SEQ ID NO: 803769 - protein, 599 aa, Homo sapiens
HCRPARYSLPASAVPTAGLRATRPQRASHMEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 803770 - protein, 495 aa, Homo sapiens
HCRPARYSLPASAVPTAGLRATRPQRASHMEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGSGTRQFESKQRASEWEFCSPSGSASPRVP

SEQ ID NO: 803771 - protein, 599 aa, Homo sapiens; identical to SEQ ID NO: 803769

SEQ ID NO: 803772 - protein, 556 aa, Homo sapiens
MSLLLLLLLLLLLLLLLLLVLLLLLLPGSPQFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 803773 - protein, 599 aa, Homo sapiens; identical to SEQ ID NO: 803769

SEQ ID NO: 803774 - protein, 144 aa, Homo sapiens
MNTCHAGHLNGVYYQGGTYSKASTPNGYDNGIILGHLENPVVFHEENHYEDNPIQQTHNWRRTATPPGGSQTGWRRLKDTFDVGKTGEPQSDQQMRQEEPLPEHPQDGAKLSRKQLVLRRGLLLLGVFLILLVGILVRFYVRIQ

SEQ ID NO: 803775 - protein, 506 aa, Homo sapiens
HCRPARYSLPASAVPTAGLRATRPQRASHMEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMEQCPMCSPSSMAGSLEGNGWPVPFSSPSSHSAASTSLLVQP

SEQ ID NO: 803776 - protein, 321 aa, Homo sapiens
HCRPARYSLPASAVPTAGLRATRPQRASHMEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKASFLRLAIPSMLMLCMEWWAYEVGSFLSGILGMVELGAQSIVYELAIIVYMRHH

SEQ ID NO: 803777 - protein, 210 aa, Homo sapiens
RPARYSLPASAVPTAGLRATRPQRASHMEAPEEPAPVRGGPEATLEVRGSRCLRLSAFREELRALLVLAGPAVSKVASVAGRYRRAGDLVISASAGDFGGLWGPSELSAGGLRGASCQEPGGHPSSSACVPAAFRSAPPDWGPRGALRERLVRARAHVGSERPAAPASCARRHRRAGTFAPNGALPGPGCICIRGCLLWELIPANKTQVA

SEQ ID NO: 803778 - protein, 436 aa, Homo sapiens
MSLNPSRPSSSELVELHVFYVPEGSWNYKLNTISTEVVNKFISAGFLRVSPQLTLRALRERLGEFLGEDAIAEKFLFLKCIGNNLAVVKEKQESELKLKSFAPPYALQPELYLLPVMDHLGNVYSPSTVILDERQTNNGVNEADGTIHRPISVTLFKEELGRDPSLLENTLKELPNKNQEEAGGKATAEKSQIAKNQIGNSELPGSLEDSNNDCFGTKKSVFGKMKMIQLSVEDSDNQTAEKEYITLPDHPSLPCQPVLSSGITDISLLQTEREKIIKQMKQVKEERRYLERNREEPVKTVEKLFEQSKLKRYHAYNGWKKKYLETKKVTASMEEVLTKLREDLELYYKKLLMQLEAREIKMRPKNLANITDSKNYLIIQITEVQHAIDQLKRKLDTDKMKLIVEVKMRKQAVSDLRTLKTELAQKKKIIHLYNLN

SEQ ID NO: 803779 - protein, 284 aa, Homo sapiens
MKKDKKRNKIPIDNYPIQTLVNMSLNPSRPSSSELVELHVFYVPEGSWNYKLNTISTEVVNKFISAGFLRVSPQLTLRALRERLGEFLGEDAIAEKFLFLKCIGNNLAVVKEKQESELKLKSFAPPYALQPELYLLPVMDHLGNVYSPSTVILDERQTNNGVNEADGTIHRPISVTLFKEELGRDPSLLENTLKELPNKNQEEAGGKATAEKSQIAKNQIGNSELPGSLEDSNNDCFGTKKSVFGKMKMIQLSVEDRTIRQLKKSTSPYQITLHFLVNLFFLQE

SEQ ID NO: 803780 - protein, 211 aa, Homo sapiens
MKKDKKRNKIPIDNYPIQTLVNMSLNPSRPSSSELVELHVFYVPEGSWNYKLNTISTEVVNKFISAGFLRVSPQLTLRALRERLGEFLGEDAIAEKFLFLKCIGNNLAVVKEKQESELKLKSFAPPYALQPELYLLPVMDHLGNVYSPSTVILDERQTNNGVNEADGTIHRPISVTLFKEELGRDPSLLENTLKELPNKNQEEEMKTHTDS

SEQ ID NO: 803781 - protein, 68 aa, Homo sapiens
YNGWKKKYLETKKVTASMEEVLTKLREDLELYYKKLLMQLEAREIKMRPKNLANITDSKVLLNVSPFR

SEQ ID NO: 803782 - protein, 492 aa, Homo sapiens
GQEARKEPPGAMDGAVMEGPLFLQSQRFGTKRWRKTWAVLYPASPHGVARLEFFDHKGSSSGGGRGSSRRLDCKVIRLAECVSVAPVTVETPPEPGATAFRLDTAQRSHLLAADAPSSAAWVQTLCRNAFPKGSWTLAPTDNPPKLSALEMLENSLYSPTWEGSQFWVTVQRTEAAERCGLHGSYVLRVEAERLTLLTVGAQSQILEPLLSWPYTLLRRYGRDKVMFSFEAGRRCPSGPGTFTFQTAQGNDIFQAVETAIHRQKAQGKAGQGHDVLRADSHEGEVAEGKLPSPPGPQELLDSPPALYAEPLDSLRIAPCPSQDSLYSDPLDSTSAQAGEGVQRKKPLYWDLYEHAQQQLLKAKLTDPKEDPIYDEPEGLAPVPPQGLYDLPREPKDAWWCQARVKEEGYELPYNPATDDYAVPPPRSTKPLLAPKPQGPAFPEPGTATGSGIKSHNSALYSQVQKSGASGSWDCGLSRVGTDKTGVKSEGST

SEQ ID NO: 803783 - protein, 519 aa, Homo sapiens
GRVLTELGNRWPAAPALESPPRLGVASRGRRAPRGRGIRLPAQASATREREPRWSPFQRWRKTWAVLYPASPHGVARLEFFDHKGSSSGGGRGSSRRLDCKVIRLAECVSVAPVTVETPPEPGATAFRLDTAQRSHLLAADAPSSAAWVQTLCRNAFPKGSWTLAPTDNPPKLSALEMLENSLYSPTWEGSQFWVTVQRTEAAERCGLHGSYVLRVEAERLTLLTVGAQSQILEPLLSWPYTLLRRYGRDKVMFSFEAGRRCPSGPGTFTFQTAQGNDIFQAVETAIHRQKAQGKAGQGHDVLRADSHEGEVAEGKLPSPPGPQELLDSPPALYAEPLDSLRIAPCPSQDSLYSDPLDSTSAQAGEGVQRKKPLYWDLYEHAQQQLLKAKLTDPKEDPIYDEPEGLAPVPPQGLYDLPREPKDAWWCQARVKEEGYELPYNPATDDYAVPPPRSTKPLLAPKPQGPAFPEPGTATGSGIKSHNSALYSQVQKSGASGSWDCGLSRVGTDKTGVKSEGST

SEQ ID NO: 803784 - protein, 267 aa, Homo sapiens
MFSFEAGRRCPSGPGTFTFQTAQGNDIFQAVETAIHRQKAQGKAGQGHDVLRADSHEGEVAEGKLPSPPGPQELLDSPPALYAEPLDSLRIAPCPSQDSLYSDPLDSTSAQAGEGVQRKKPLYWDLYEHAQQQLLKAKLTDPKEDPIYDEPEGLAPVPPQGLYDLPREPKDAWWCQARVKEEGYELPYNPATDDYAVPPPRSTKPLLAPKPQGPAFPEPGTATGSGIKSHNSALYSQVQKSGASGSWDCGLSRVGTDKTGVKSEGST

SEQ ID NO: 803785 - protein, 104 aa, Homo sapiens
GRVLTELGNRWPAAPALESPPRLGVASRGRRAPRGRGIRLPAQASATREREPRWSPFQVMLYLGAGPQAGKESQWHLSCVPPPLRNPAWCACCKPSGGMGPRRR

SEQ ID NO: 803786 - protein, 267 aa, Homo sapiens; identical to SEQ ID NO: 803784

SEQ ID NO: 803787 - protein, 100 aa, Homo sapiens
MFSFEAGRRCPSGPGTFTFQTAQGNDIFQAVETAIHRQKAQGKAGQGHDVLRADSHEGEVAEGKLPSPPGPQELLDSPPALYAEPLDSLRIAPCPSQDSL

SEQ ID NO: 803788 - protein, 80 aa, Homo sapiens
EPSLRISWGVNVNISLEYLIGFQSEPCFGFFLAAVMISTYKVWLSGFQKLAFKTTGSLSELNENQPGQIKCFNKGIFLWE

SEQ ID NO: 803789 - protein, 132 aa, Homo sapiens
SSDMVCELLGVRGMDILYIGDHIFGDILKSKKRQGWRTCLVVPELSWELDIWAQEKERLEELKRLDTHLADIYQHMDGSSCELQVINFTKREIQMPHESVVEQEQANLDPASCLLSCNQRSLPAKSCLSSAI

SEQ ID NO: 803790 - protein, 1246 aa, Homo sapiens
MPTEVLATPGYFPTVVQPYVESNLLVPMGGVGGQVQVSQPGGSLAQAPTTSSQQAVLESTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGNKATIIVQKQ

SEQ ID NO: 803791 - protein, 90 aa, Homo sapiens
KSWTCFLMPLYLLAGNLSGQSAASVLHPQQTLHPPGNIPESGQNQLLQPLKPSPSSDNLYSAFTSDGAISVPSLSAPGQGNKATIIVQKQ

SEQ ID NO: 803792 - protein, 97 aa, Homo sapiens
VIVFIQSQQPLEDLDAQLRRTLSPEMITVTSAVGPVSMAAPTAITEAGTQPQKGVSQVKEGPVLATSSGAGVFKMGRFQFLMQHTVSQKRGSSRTSA

SEQ ID NO: 803793 - protein, 2382 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803794 - protein, 2382 aa, Homo sapiens; identical to SEQ ID NO: 803793

SEQ ID NO: 803795 - protein, 2382 aa, Homo sapiens; identical to SEQ ID NO: 803793

SEQ ID NO: 803796 - protein, 2382 aa, Homo sapiens; identical to SEQ ID NO: 803793

SEQ ID NO: 803797 - protein, 2382 aa, Homo sapiens; identical to SEQ ID NO: 803793

SEQ ID NO: 803798 - protein, 2382 aa, Homo sapiens; identical to SEQ ID NO: 803793

SEQ ID NO: 803799 - protein, 2108 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803800 - protein, 2382 aa, Homo sapiens; identical to SEQ ID NO: 803793

SEQ ID NO: 803801 - protein, 2229 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803802 - protein, 2354 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803803 - protein, 2382 aa, Homo sapiens; identical to SEQ ID NO: 803793

SEQ ID NO: 803804 - protein, 2382 aa, Homo sapiens; identical to SEQ ID NO: 803793

SEQ ID NO: 803805 - protein, 2043 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803806 - protein, 2382 aa, Homo sapiens; identical to SEQ ID NO: 803793

SEQ ID NO: 803807 - protein, 2047 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803808 - protein, 1715 aa, Homo sapiens
PSFSSNKKSVLPFLMDIKKKDFCSVFVIINSHCCCCPQKDCINEGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803809 - protein, 1581 aa, Homo sapiens
SRGSRAENVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803810 - protein, 1304 aa, Homo sapiens
MSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803811 - protein, 1304 aa, Homo sapiens; identical to SEQ ID NO: 803810

SEQ ID NO: 803812 - protein, 1411 aa, Homo sapiens
SKYYLPSSQPIQHPQQQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803813 - protein, 1518 aa, Homo sapiens
MAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803814 - protein, 1244 aa, Homo sapiens
MLSRVGVEEVFHQPAAEQRCGAWSSSRSTQTVYSAVSHLDGSSSRSRHPPGSPAAGQQPRASERVSGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803815 - protein, 981 aa, Homo sapiens
HISTPSVTYSVHISHILSTPSVSTPSVTSVRTPSVTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803816 - protein, 931 aa, Homo sapiens
MLIIRLVLYRGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803817 - protein, 788 aa, Homo sapiens
HARDPFCTLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803818 - protein, 145 aa, Homo sapiens
MTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803819 - protein, 312 aa, Homo sapiens
MTSHDIVNLVAPRMTGLLRICTTGKKEQYLRTTSNKAIEGKDYTLLTISKVEMCHMEEIEKKPTSLYRGNPCVLGPGVQAIVSRWRPPQGRTRIRNRPWQRIAMSSGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803820 - protein, 170 aa, Homo sapiens
PPPPLMCHYVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 803821 - protein, 2066 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISKSETYFIPEEQWSLMQHIIICYLGLIIILTSFHSYTKKVRTGVIYC

SEQ ID NO: 803822 - protein, 1951 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGNKATIIVQKQ

SEQ ID NO: 803823 - protein, 2032 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISIPITISSIPPQP

SEQ ID NO: 803824 - protein, 2013 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEVSLSFAAENP

SEQ ID NO: 803825 - protein, 2003 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDKVEPRDKVEPRDKVEPRDKVEP

SEQ ID NO: 803826 - protein, 1990 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPRPPRAGR

SEQ ID NO: 803827 - protein, 1439 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTRCKTGPV

SEQ ID NO: 803828 - protein, 983 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSSPPLTTTPNTD

SEQ ID NO: 803829 - protein, 393 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGMFQVYLGA

SEQ ID NO: 803830 - protein, 102 aa, Homo sapiens
EQEKKKQEESSLKQQVEQSSASQTGIKQLPSASTGIPTASTTSASVSTQVEPEEPEADQHQQLQYQQPSISVLCTYLGKWTDRLMILLIGFFSFLLFCTGFL

SEQ ID NO: 803831 - protein, 289 aa, Homo sapiens
MRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPSFGKSSRIKVKDTTFRDKKSSLMEELFGSGYVLKTDQSSPGVAKGSEEPLQSKESHPLPPSQASTSHAFGDSKVTVVNSIKPSS

SEQ ID NO: 803832 - protein, 110 aa, Homo sapiens [sequence omitted]

SEQ ID NO: 803833 - protein, 660 aa, Homo sapiens
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSKGQKEISVEKKHTWNASLFNSQIHMIAQRRDAMAHRILSARLHKIKGLKNELADMHHKLEAILTENQFLKQLQLRHLKAIGKYENSQNNLPQIMAKHQNEVKNLRQLLRKSQEKERTLSRKLRETDSQLLKTKDILQALQKLSEDKNLAEREELTHKLSIITTKMDANDKKIQSLEKQLRLNCRAFSRQLAIETRKTLAAQTATKTLQVEVKHLQQKLKEKDRELEIKNIYSHRILKNLHDTEDYPKVSSTKSVQADRKILPFTSMRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPSFGKSSRIKVKDTTFRDKKSSLMEELFGSGYVLKTDQSSPGVAKGSEEPLQSKESHPLPPSQASTSHAFGDSKVTVVNSIKPSS

SEQ ID NO: 803834 - protein, 288 aa, Homo sapiens
MSLADLTKTNIDEHFFGVALENNRRSAACKRSPGTGDFSRNSNASNKSVDYSRSQCSCGSLSSQYDYSEDFLCDCSEKAINRNYLKQPVVKEKEKKKYNVSKISQSKGQKEISVEKKHTWNASLFNSQIHMIAQRRDAMAHRILSARLHKIKGLKNELADMHHKLEAILTENQFLKQLQLRHLKAIGKYENSQNNLPQIMAKHQNEVKNLRQLLRKSQEKERTLSRKLRETDSQLLKTKDILQALQKLSEDKNLAEREELTHKLSIITTKMDANDKKIQVCISGAQTV

SEQ ID NO: 803835 - protein, 660 aa, Homo sapiens; identical to SEQ ID NO: 803833

SEQ ID NO: 803836 - protein, 660 aa, Homo sapiens; identical to SEQ ID NO: 803833

SEQ ID NO: 803837 - protein, 660 aa, Homo sapiens; identical to SEQ ID NO: 803833

SEQ ID NO: 803838 - protein, 660 aa, Homo sapiens; identical to SEQ ID NO: 803833

SEQ ID NO: 803839 - protein, 660 aa, Homo sapiens; identical to SEQ ID NO: 803833

SEQ ID NO: 803840 - protein, 461 aa, Homo sapiens
MAKHQNEVKNLRQLLRKSQEKERTLSRKLRETDSQLLKTKDILQALQKLSEDKNLAEREELTHKLSIITTKMDANDKKIQSLEKQLRLNCRAFSRQLAIETRKTLAAQTATKTLQVEVKHLQQKLKEKDRELEIKNIYSHRILKNLHDTEDYPKVSSTKSVQADRKILPFTSMRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPSFGKSSRIKVKDTTFRDKKSSLMEELFGSGYVLKTDQSSPGVAKGSEEPLQSKESHPLPPSQASTSHAFGDSKVTVVNSIKPSS

SEQ ID NO: 803841 - protein, 522 aa, Homo sapiens
MAHRILSARLHKIKGLKNELADMHHKLEAILTENQFLKQLQLRHLKAIGKYENSQNNLPQIMAKHQNEVKNLRQLLRKSQEKERTLSRKLRETDSQLLKTKDILQALQKLSEDKNLAEREELTHKLSIITTKMDANDKKIQSLEKQLRLNCRAFSRQLAIETRKTLAAQTATKTLQVEVKHLQQKLKEKDRELEIKNIYSHRILKNLHDTEDYPKVSSTKSVQADRKILPFTSMRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPSFGKSSRIKVKDTTFRDKKSSLMEELFGSGYVLKTDQSSPGVAKGSEEPLQSKESHPLPPSQASTSHAFGDSKVTVVNSIKPSS

SEQ ID NO: 803842 - protein, 660 aa, Homo sapiens; identical to SEQ ID NO: 803833

SEQ ID NO: 803843 - protein, 522 aa, Homo sapiens; identical to SEQ ID NO: 803841

SEQ ID NO: 803844 - protein, 390 aa, Homo sapiens
MDANDKKIQSLEKQLRLNCRAFSRQLAIETRKTLAAQTATKTLQVEVKHLQQKLKEKDRELEIKNIYSHRILKNLHDTEDYPKVSSTKSVQADRKILPFTSMRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPSFGKSSRIKVKDTTFRDKKSSLMEELFGSGYVLKTDQSSPGVAKGSEEPLQSKESHPLPPSQASTSHAFGDSKVTVVNSIKPSS

SEQ ID NO: 803845 - protein, 660 aa, Homo sapiens; identical to SEQ ID NO: 803833

SEQ ID NO: 803846 - protein, 660 aa, Homo sapiens; identical to SEQ ID NO: 803833

SEQ ID NO: 803847 - protein, 532 aa, Homo sapiens
MAHRILSARLHKIKGLKNLAEIFKAVGNELADMHHKLEAILTENQFLKQLQLRHLKAIGKYENSQNNLPQIMAKHQNEVKNLRQLLRKSQEKERTLSRKLRETDSQLLKTKDILQALQKLSEDKNLAEREELTHKLSIITTKMDANDKKIQSLEKQLRLNCRAFSRQLAIETRKTLAAQTATKTLQVEVKHLQQKLKEKDRELEIKNIYSHRILKNLHDTEDYPKVSSTKSVQADRKILPFTSMRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPSFGKSSRIKVKDTTFRDKKSSLMEELFGSGYVLKTDQSSPGVAKGSEEPLQSKESHPLPPSQASTSHAFGDSKVTVVNSIKPSS

SEQ ID NO: 803848 - protein, 144 aa, Homo sapiens
SGDAPALRRWRSRGNSAEQVTAPLLPSSPSAGYPVTAPALGPSGPSCYALSGLPVSPVTQSSPLPASLAPRRFLLAAQFAKEQLPRLGSDRALRRHTYSQARWAGGRPGPSLSALPSKCTQNRFTILPFLSTATVTTLVQAPII

SEQ ID NO: 803849 - protein, 410 aa, Homo sapiens
MLENYQNLVWLGLSISKSVISLLEKRKLPWIMAKEEIRGPLPDVPGAEIKELSAKRAINEVLSQFDTVIKCTRNVCKECGNLYCHNMQLTLHKRNHTQKKCNQCLDCGKYFTRQSTLIQHQRIHTGERPYKCNECIKTFNQRAHLTKHERIHTGEKPYKCKECRKTFSQMTHLTQHQTTHTREKFHECSECGKAFSRVSALIDHQRIHSGEKPYECKECGRAFTQSAQLIRHQKTHSGEKPYECSKCKKSFVHLSSLIEHWRIHTGEKPYQCKDCKKTFCRVMQFTLHRRIHTGEKPYECKECGKSFSAHSSLVTHKRTHSGEKPYKCKECGKAFSAHSSLVTHKRTHSGEKPYTCHACGKAFNTSSTLCQHNRIHTGEKPFQCSQCGKSFSCSSHLTRHCRMCNGKFSK

SEQ ID NO: 803850 - protein, 434 aa, Homo sapiens
MLENYQNLVWLGLSISKSVISLLEKRKLPWIMAKEEIRGPLPGYFKVSEMTISQEPKAKTRTLFGKDVPGAEIKELSAKRAINEVLSQFDTVIKCTRNVCKECGNLYCHNMQLTLHKRNHTQKKCNQCLDCGKYFTRQSTLIQHQRIHTGERPYKCNECIKTFNQRAHLTKHERIHTGEKPYKCKECRKTFSQMTHLTQHQTTHTREKFHECSECGKAFSRVSALIDHQRIHSGEKPYECKECGRAFTQSAQLIRHQKTHSGEKPYECSKCKKSFVHLSSLIEHWRIHTGEKPYQCKDCKKTFCRVMQFTLHRRIHTGEKPYECKECGKSFSAHSSLVTHKRTHSGEKPYKCKECGKAFSAHSSLVTHKRTHSGEKPYTCHACGKAFNTSSTLCQHNRIHTGEKPFQCSQCGKSFSCSSHLTRHCRMCNGKFSK

SEQ ID NO: 803851 - protein, 410 aa, Homo sapiens; identical to SEQ ID NO: 803849

SEQ ID NO: 803852 - protein, 241 aa, Homo sapiens
MLENYQNLVWLGLSISKSVISLLEKRKLPWIMAKEEIRGPLPDVPGAEIKELSAKRAINEVLSQFDTVIKCTRNVCKECGNLYCHNMQLTLHKRNHTQKKCNQCLDCGKYFTRQSTLIQHQRIHTGERPYKCNECIKTSAHSSLVTHKRTHSGEKPYKCKECGKAFSAHSSLVTHKRTHSGEKPYTCHACGKAFNTSSTLCQHNRIHTGEKPFQCSQCGKSFSCSSHLTRHCRMCNGKFSK

SEQ ID NO: 803853 - protein, 146 aa, Homo sapiens
MLENYQNLVWLGLSISKSVISLLEKRKLPWIMAKEEIRGPLPDVPGAEIKELSAKRAINEVLSQFDTVIKCTRNVCKECGNLYCHNMQLTLHKRNHTQKKCNQCLDCGKYFTRQSTLIQHQRIHTGERPYKCNECIKTFNQRAHLT

SEQ ID NO: 803854 - protein, 241 aa, Homo sapiens; identical to SEQ ID NO: 803852

SEQ ID NO: 803855 - protein, 102 aa, Homo sapiens
MNAGARTEAQHPGLEVRADALAGPLLELRELPAAGLDDGLDLLLGLLGDGHHAVQVLVHKETHKHLWRHGPWEGLALALPPSHPTCFRPVLTLKALRRSGSM

SEQ ID NO: 803856 - protein, 269 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDLAGLRQFFKQLPSPPFLPAAGTADCR

SEQ ID NO: 803857 - protein, 107 aa, Homo sapiens
MAALPPCQYRRTMSASRAFSCLQSSSIVPARGPTLGSYGGHCINSSADTHSHDTNKQTALMFIQRIWLTSRWEVRPYRLAGLPQRLRPNRGAPCVPLAARTCPFSEV

SEQ ID NO: 803858 - protein, 191 aa, Homo sapiens
MSAALFSLDGPARGAPWPAEPAPFYEPGRAGKPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDLAGLRQFFKQLPSPPFLPAAGTADCR

SEQ ID NO: 803859 - protein, 269 aa, Homo sapiens; identical to SEQ ID NO: 803856

SEQ ID NO: 803860 - protein, 269 aa, Homo sapiens; identical to SEQ ID NO: 803856

SEQ ID NO: 803861 - protein, 269 aa, Homo sapiens; identical to SEQ ID NO: 803856

SEQ ID NO: 803862 - protein, 269 aa, Homo sapiens; identical to SEQ ID NO: 803856

SEQ ID NO: 803863 - protein, 269 aa, Homo sapiens; identical to SEQ ID NO: 803856

SEQ ID NO: 803864 - protein, 269 aa, Homo sapiens; identical to SEQ ID NO: 803856

SEQ ID NO: 803865 - protein, 235 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPKSRDKAKRRNQEMQQKLVELSAENEKLHQRVEQLTRDLAGLRQFFKQLPSPPFLPAAGTADCR

SEQ ID NO: 803866 - protein, 109 aa, Homo sapiens
QGRRPSFTGGRQSPVLPGRTGPPGGPAPLNRVLLLGGLRCSWGGRWKSRDKAKRRNQEMQQKLVELSAENEKLHQRVEQLTRDLAGLRQFFKQLPSPPFLPAAGTADCR

SEQ ID NO: 803867 - protein, 282 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRGRRDSRLPVTRGRGGRDSATTHTSDPTARSGARPALAQPEPPGARCSFLGHRSAKKLQPGLTTTKLREKLNVFIFP

SEQ ID NO: 803868 - protein, 248 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPGRRDSRLPVTRGRGGRDSATTHTSDPTARSGARPALAQPEPPGARCSFLGHRSAKKLQPGLTTTKLREKLNVFIFP

SEQ ID NO: 803869 - protein, 275 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDLAGLRQFFKQLPSPPFLPAKGKPFGPPGGFLK

SEQ ID NO: 803870 - protein, 274 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDQSRRVPAAVSWDIGAQRSYSLDLPPLNCERS

SEQ ID NO: 803871 - protein, 195 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPPERSAPCPGAARAAGCPLQFLGT

SEQ ID NO: 803872 - protein, 257 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMPEPPGARCSFLGHRSAKKLQPGLTTTKLREKLNVFIFP

SEQ ID NO: 803873 - protein, 242 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMLSWDIGAQRSYSLDLPPLNCERS

SEQ ID NO: 803874 - protein, 83 aa, Homo sapiens
ELLEELPEAGQVPRELLHALVQLLVLSLTAPPTSAREAKRVYFPLNYFCNGSFFYILLLLMQLRYICKKKKNQTFQTNPLYCR

SEQ ID NO: 803875 - protein, 754 aa, Homo sapiens
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 803876 - protein, 571 aa, Homo sapiens
VGVCPRSYFLEGRGSYSFLSLFSTSPAPYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 803877 - protein, 200 aa, Homo sapiens
MANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 803878 - protein, 135 aa, Homo sapiens
TGAICLDILKDQCFRPVAGRMWWLMPVIPAVWEAEAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 803879 - protein, 201 aa, Homo sapiens
MANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAYSGLFQIWVDGQIGLRIGYKRVI

SEQ ID NO: 803880 - protein, 118 aa, Homo sapiens
GGGRSGGGGGGYESAAGGDMANIAVQRIKREFKEVLKSEETSKNQIKVDLVDENFTELRGEIAGPPDTPYEGGRYQLEIKIPETYPFNPPKPVNTKIWHPNIRLEQTKHPTKKNKRII

SEQ ID NO: 803881 - protein, 200 aa, Homo sapiens; identical to SEQ ID NO: 803877

SEQ ID NO: 803882 - protein, 200 aa, Homo sapiens; identical to SEQ ID NO: 803877

SEQ ID NO: 803883 - protein, 200 aa, Homo sapiens; identical to SEQ ID NO: 803877

SEQ ID NO: 803884 - protein, 210 aa, Homo sapiens
MNRGGFKIFIGNTLGVFLADITNIYFLFILKTSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 803885 - protein, 219 aa, Homo sapiens
GGGRSGGGGGGYESAAGGDMANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 803886 - protein, 200 aa, Homo sapiens; identical to SEQ ID NO: 803877

SEQ ID NO: 803887 - protein, 149 aa, Homo sapiens
MANIAVQRIKREFKEVLKSEEVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 803888 - protein, 198 aa, Homo sapiens
GGGRSGGGGGGYESAAGGDMANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRVST

SEQ ID NO: 803889 - protein, 200 aa, Homo sapiens; identical to SEQ ID NO: 803877

SEQ ID NO: 803890 - protein, 200 aa, Homo sapiens; identical to SEQ ID NO: 803877

SEQ ID NO: 803891 - protein, 157 aa, Homo sapiens
MANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQNAVIVALSSKSWDVETATELLLSN

SEQ ID NO: 803892 - protein, 654 aa, Homo sapiens
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQTGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 803893 - protein, 654 aa, Homo sapiens; identical to SEQ ID NO: 803892

SEQ ID NO: 803894 - protein, 689 aa, Homo sapiens
HASATRRHAVPLEELPSWWLERPLVLWWRCVLQAHMAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQTGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 803895 - protein, 414 aa, Homo sapiens
HASATRLPRCPAGGAPQLVAGATPCSLVALFVLQAHMAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQTGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHLSRHRKTTSVHHRLPVQPDPEPCAGQPSDSLYSL

SEQ ID NO: 803896 - protein, 627 aa, Homo sapiens
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEDRSNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLSETLHINPLYTLIPVTMCISFAVMLPVGNPPNAIVFSYGHCQIKDMVKAGLGVNVIGLVIVMVAINTWGVSLFHLDTYPAWARVSNITDQA

SEQ ID NO: 803897 - protein, 47 aa, Homo sapiens
MCCTTLLSMWLSNTSTTAMVMPIVEAVLQELVSRVKTPRKILLSHFK

SEQ ID NO: 803898 - protein, 581 aa, Homo sapiens
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEDRSNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLVKAGLGVNVIGLVIVMVAINTWGVSLFHLDTYPAWARVSNITDQA

SEQ ID NO: 803899 - protein, 627 aa, Homo sapiens; identical to SEQ ID NO: 803896

SEQ ID NO: 803900 - protein, 374 aa, Homo sapiens
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEDRSNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDIR

SEQ ID NO: 803901 - protein, 254 aa, Homo sapiens
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEDRSNADLTTLMHNENLNGVPSITNPRPTPEGIPPPEDSATSSELQESSNNHKHMLRC

SEQ ID NO: 803902 - protein, 204 aa, Homo sapiens
MVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLVKAGLGVNVIGLVIVMVAINTWGVSLFHLDTYPAWARVSNITDQA

SEQ ID NO: 803903 - protein, 204 aa, Homo sapiens; identical to SEQ ID NO: 803902

SEQ ID NO: 803904 - protein, 581 aa, Homo sapiens; identical to SEQ ID NO: 803898

SEQ ID NO: 803905 - protein, 396 aa, Homo sapiens
MTRWSFSRHLAHHFLFLIVRWPLSQQNLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLVKAGLGVNVIGLVIVMVAINTWGVSLFHLDTYPAWARVSNITDQA

SEQ ID NO: 803906 - protein, 258 aa, Homo sapiens
MLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLVKAGLGVNVIGLVIVMVAINTWGVSLFHLDTYPAWARVSNITDQA

SEQ ID NO: 803907 - protein, 111 aa, Homo sapiens
LPSQESASLTWLLCPLLGSSRSNADLTTLMHNEVWPWGFSVLWNHLKIPQHFFMETQDSEPDFQQLQIHLRVPFSEDSIDKMLLLKRTHWLGVVAHACTPSTLGGHSRRTT

SEQ ID NO: 803908 - protein, 242 aa, Homo sapiens
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 803909 - protein, 242 aa, Homo sapiens; identical to SEQ ID NO: 803908

SEQ ID NO: 803910 - protein, 242 aa, Homo sapiens; identical to SEQ ID NO: 803908

SEQ ID NO: 803911 - protein, 242 aa, Homo sapiens; identical to SEQ ID NO: 803908

SEQ ID NO: 803912 - protein, 242 aa, Homo sapiens; identical to SEQ ID NO: 803908

SEQ ID NO: 803913 - protein, 242 aa, Homo sapiens; identical to SEQ ID NO: 803908

SEQ ID NO: 803914 - protein, 259 aa, Homo sapiens
MGKNFSDSFLSRECVIRMVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 803915 - protein, 242 aa, Homo sapiens; identical to SEQ ID NO: 803908

SEQ ID NO: 803916 - protein, 242 aa, Homo sapiens; identical to SEQ ID NO: 803908

SEQ ID NO: 803917 - protein, 263 aa, Homo sapiens
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQLLLQLRPGSRPFPVTYVSVTGRQPYKSW

SEQ ID NO: 803918 - protein, 154 aa, Homo sapiens
MAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 803919 - protein, 242 aa, Homo sapiens; identical to SEQ ID NO: 803908

SEQ ID NO: 803920 - protein, 140 aa, Homo sapiens
MQLMPKLWCPVCSSPGSHCHLQRGSLLRPTLLHLAPPWLLAWPNLAFCAMLELELLLFFRGGNRVESGKGLAPKCCCCGFFAFSKDALPGPKLQTAVLSKQVRSLGFGAHLLSGSISILLLATSGQRPPQPHIARCWQKG

SEQ ID NO: 803921 - protein, 140 aa, Homo sapiens; identical to SEQ ID NO: 803920

SEQ ID NO: 803922 - protein, 183 aa, Homo sapiens
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSL

SEQ ID NO: 803923 - protein, 125 aa, Homo sapiens
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTLPDVGRRANIDRLDWLEPSKPLGCPPGTWVP

SEQ ID NO: 803924 - protein, 1977 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVRRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 803925 - protein, 396 aa, Homo sapiens [sequence omitted]

SEQ ID NO: 803926 - protein, 168 aa, Homo sapiens [sequence omitted]

SEQ ID NO: 803927 - protein, 100 aa, Homo sapiens
CMLTTTQTNGQGDQQNPAPAGQVDYTKAWEEYYKKMGQAVPAPTGAPPGGQPDYSAAWAEYYRQQAAYYAQTSPQGMPQHPPAPQKLPVCKKKIGLKWLL

SEQ ID NO: 803928 - protein, 84 aa, Homo sapiens
MSRTNNPGQGDQQNPAPAGQVDYTKAWEEYYKKMGQAVPAPTGAPPGGQPDYSAAWAEYYRQQAAYYAQTSPQGMPQHPPAPQV

SEQ ID NO: 803929 - protein, 114 aa, Homo sapiens
HRGMFVVSRCHFRKIPKIISFHFQVEHLTFWLCSIGNKIFVQQLQNIIADVLQFCLYLLTVLFAHLLLLLIPLCFLLNAGDDTPGRAAGAYHILVGNREPGRLQQKLEVMQGHH

SEQ ID NO: 803930 - protein, 644 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 803931 - protein, 383 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQLDLVVEEEVEVKATGTWDHLVDYRNLILLCQLGKLD

SEQ ID NO: 803932 - protein, 594 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTILVLQPHMLPRDGEMHIHTGSSRLLLIQLRQERIQIQQLGLLITLTIINSKHSHHQQPLQVHQLQLKLMDKEISRIQPQLDRLIIPRLGKSTTRKWVRQFLLRLGLLQVVSQIIVQPGLSIIDNKQPIMPRQVPRECHSILQHLRANNKKWTIQYLLHCVGEKNLC

SEQ ID NO: 803933 - protein, 644 aa, Homo sapiens; identical to SEQ ID NO: 803930

SEQ ID NO: 803934 - protein, 644 aa, Homo sapiens; identical to SEQ ID NO: 803930

SEQ ID NO: 803935 - protein, 644 aa, Homo sapiens; identical to SEQ ID NO: 803930

SEQ ID NO: 803936 - protein, 626 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQNALELGLQETHIYVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 803937 - protein, 613 aa, Homo sapiens
SWSTSGSWQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 803938 - protein, 665 aa, Homo sapiens
MADYSTVPPPSSGSAGGGGGGGGGGGVNDAFKDALQRARQIAAKIGGDAGTSLNSNDYGYGGQKRPLEDGDGSWTSPSSTTHWEGMPSPFKDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 803939 - protein, 398 aa, Homo sapiens
MNEEIKFKGVTNFYQSDLSDMVELGKDGANFMSVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 803940 - protein, 375 aa, Homo sapiens
CCVVLEDPNVVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 803941 - protein, 644 aa, Homo sapiens; identical to SEQ ID NO: 803930

SEQ ID NO: 803942 - protein, 644 aa, Homo sapiens; identical to SEQ ID NO: 803930

SEQ ID NO: 803943 - protein, 644 aa, Homo sapiens; identical to SEQ ID NO: 803930

SEQ ID NO: 803944 - protein, 644 aa, Homo sapiens; identical to SEQ ID NO: 803930

SEQ ID NO: 803945 - protein, 644 aa, Homo sapiens; identical to SEQ ID NO: 803930

SEQ ID NO: 803946 - protein, 644 aa, Homo sapiens; identical to SEQ ID NO: 803930

SEQ ID NO: 803947 - protein, 668 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQCLPRPSTLGSAAKSTRNYPCVKRRLA

SEQ ID NO: 803948 - protein, 643 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQV

SEQ ID NO: 803949 - protein, 452 aa, Homo sapiens [sequence omitted]

SEQ ID NO: 803950 - protein, 463 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPLTPWSHR

SEQ ID NO: 803951 - protein, 217 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQVLLFL

SEQ ID NO: 803952 - protein, 765 aa, Homo sapiens
MAGFKRGYDGKIAGLYDLDKTLGRGHFAVVKLARHVFTGEKVAVKVIDKTKLDTLATGHLFQEVRCMKLVQHPNIVRLYEVIDTQTKLYLILELGDGGDMFDYIMKHEEGLNEDLAKKYFAQIVHAISYCHKLHVVHRDLKPENVVFFEKQGLVKLTDFGFSNKFQPGKKLTTSCGSLAYSAPEILLGDEYDAPAVDIWSLGVILFMLVCGQPPFQEANDSETLTMIMDCKYTVPSHVSKECKDLITRMLQRDPKRRASLEEIENHPWLQGVDPSPATKYNIPLVSYKNLSEEEHNSIIQRMVLGDIADRDAIVEALETNRYNHITATYFLLAERILREKQEKEIQTRSASPSNIKAQFRQSWPTKIDVPQDLEDDLTATPLSHATVPQSPARAADSVLNGHRSKGLCDSAKKDDLPELAGPALSTVPPASLKPTASGRKCLFRVEEDEEEDEEDKKPMSLSTQVVLRRKPSVTNRLTSRKSAPVLNQIFEEGESDDEFDMDENLPPKLSRLKMNIASPGTVHKRYHRRKSQGRGSSCSSSETSDDDSESRRRLDKDSGFTYSWHRRDSSEGPPGSEGDGGGQSKPSNASGGVDKASPSENNAGGGSPSSGSGGNPTNTSGTTRRCAGPSNSMQLASRSAGELVESLKLMSLCLGSQLHGSTKYIIDPQNGLSFSSVKVQEKSTWKMCISSTGNAGQVPAVGGIKFFSDHMADTTTELERIKSKNLKNNVLQLPLCEKTISVNIQRNPKEGLLCASSPASCCHVI

SEQ ID NO: 803953 - protein, 765 aa, Homo sapiens; identical to SEQ ID NO: 803952

SEQ ID NO: 803954 - protein, 765 aa, Homo sapiens; identical to SEQ ID NO: 803952

SEQ ID NO: 803955 - protein, 417 aa, Homo sapiens [sequence omitted]

SEQ ID NO: 803956 - protein, 116 aa, Homo sapiens
PVDYYSDSLWCSTKYIIDPQNGLSFSSVKVQEKSTWKMCISSTGNAGQVPAVGGIKFFSDHMADTTTELERIKSKNLKNNVLQLPLCEKTISVNIQRNPKEGLLCASSPASCCHVI

SEQ ID NO: 803957 - protein, 244 aa, Homo sapiens
MAGFKRGYDGKIAGLYDLDKTLGRGHFAVVKLARHVFTGEKVAVKVIDKTKLDTLATGHLFQEVRCMKLVQHPNIVRLYEVIDTQTKLYLILELGDGGDMFDYIMKHEEGLNEDLAKKYFAQIVHAISYCHKLHVVHRDLKPENVVFFEKQGLVKLTDFGFSNKFQPGKKLTTSCGSLAYSAPEILLGDEYDAPAVDIWSLGVILFMLVCGQPPFQEANDSETLTMIMDCKYTVPSHVSKECKE

SEQ ID NO: 803958 - protein, 765 aa, Homo sapiens; identical to SEQ ID NO: 803952

SEQ ID NO: 803959 - protein, 376 aa, Homo sapiens
MAGFKRGYDGKIAGLYDLDKTLGRGHFAVVKLARHVFTGEKVAVKVIDKTKLDTLATGHLFQEVRCMKLVQHPNIVRLYEVIDTQTKLYLILELGDGGDMFDYIMKHEEGLNEDLAKKYFAQIVHAISYCHKLHVVHRDLKPENVVFFEKQGLVKLTDFGFSNKFQPGKKLTTSCGSLAYSAPEILLGDEYDAPAVDIWSLGVILFMLVCGQPPFQEANDSETLTMIMDCKYTVPSHVSKECKDLITRMLQRDPKRRASLEEIENHPWLQGVDPSPATKYNIPLVSYKNLSEEEHNSIIQRMVLGDIADRDAIVEALETNRYNHITATYFLLAERILREKQEKEIQTRSASPSNIKAQFRGSAGLDLLKLCLHFLQ

SEQ ID NO: 803960 - protein, 156 aa, Homo sapiens
STDCSKLRQTMQIHVLLEEALPSGDHRGGVTVADHVGRGAGGLAPARGGLRAAGCSVLGRFDLEPRVTQSFGKVVVHGARDGHGVGCRLGLLVILAQAPAEMLLHHGVTGGGSARWPPVAGRPGRGLVPNSARGGFGGREGVVGAAAAADGRSPAG

SEQ ID NO: 803961 - protein, 399 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 803962 - protein, 371 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 803963 - protein, 329 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVCSAFLLPHPFLIPSTPSPNHHHHHLLGSLSMNRERSRSQKDLTLRSL

SEQ ID NO: 803964 - protein, 399 aa, Homo sapiens; identical to SEQ ID NO: 803961

SEQ ID NO: 803965 - protein, 414 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGGKRSSFPTCKAKAATPGPLLEMEAC

SEQ ID NO: 803966 - protein, 338 aa, Homo sapiens
RSAFSIPMAEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 803967 - protein, 399 aa, Homo sapiens; identical to SEQ ID NO: 803961

SEQ ID NO: 803968 - protein, 363 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRGKKKKRKREKLQESASGTGPRMTAAYI

SEQ ID NO: 803969 - protein, 371 aa, Homo sapiens; identical to SEQ ID NO: 803962

SEQ ID NO: 803970 - protein, 155 aa, Homo sapiens
MMFPFVSSLVFLPMKVCNTRAAMNGKESHSLQWEGSKMGSSTPESWGRAGAGRLPADRLCVHTDGSPWKVLLADPGIGEVGKIHEHCLLGTGWHALSREEQAKYYELARKERQLHMQLYPGWSARDNYGKKKKRKREKLQESASGTGPRMTAAYI

SEQ ID NO: 803971 - protein, 103 aa, Homo sapiens
MGKNLIACNGKEAKWEAPHLRVGGEQEQGGSQLTDCVCTQWHALSREEQAKYYELARKERQLHMQLYPGWSARDNYGKKKKRKREKLQESASGTGPRMTAAYI

SEQ ID NO: 803972 - protein, 235 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTFPIFRVNSLKRSGCQYAGSLTSTSPVSLPKRAHFTSLENSQPSKSTPASLSFRGQDKEEKKKLGEERGRETEEFHDSLTVYGFHWCLGNCGTSGCLR

SEQ ID NO: 803973 - protein, 438 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYVSPSSIPVALHSHSFALLRSRRKCVLGVYNAGTTYFLEVNELCNKDFMDILHYESFELSFFFCYGC

SEQ ID NO: 803974 - protein, 147 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTEFFCLFWWH

SEQ ID NO: 803975 - protein, 79 aa, Homo sapiens
RTALASSPRSRYTVTNGRGGSSAADYGLIAWCFEIRSRYPVSTQLCVEHVHAWVPGFNLIFPNSMTLTCPHEDAPGHGT

SEQ ID NO: 803976 - protein, 154 aa, Homo sapiens
MLDGRQRRGIECSHIRHAWDHAKSVRQNLAEMGLAVDPNRAVPLRKRKRSRQQQGSQGPWQGLGTIKARHDRPLKLCSLGKRGKRAPLNGWALREDENPLWGQGAPRPQGPPRPPFFPKGKHTPGEQPRRTTTQIITPPWVFPFPAGGKTPPFP

SEQ ID NO: 803977 - protein, 154 aa, Homo sapiens
MLDGRQRRGIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKAMARDEKNYYQDTPKQIRSKINVYKRFYPAEWQDFLDSLQKRKMEVE

SEQ ID NO: 803978 - protein, 110 aa, Homo sapiens
KTVVGGAMFFIGFTALVIMWQKPYVLNDLEAEASLPEKKGNTLSRDLIDYVRYMVENHGEDYKAMARDEKNYYQDTPKQIRSKINVYKRFYPAEWQDFLDSLQKRKMEVE

SEQ ID NO: 803979 - protein, 126 aa, Homo sapiens
MLDGRQRRGIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKVSGSGPVGWLGRRPGPFAA

SEQ ID NO: 803980 - protein, 214 aa, Homo sapiens
MLDGRQRRGIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKAMARDEKNYYQDTPKQIRSKINVYKRFYPAEWQDFLDSLQKRKMEVLCGSRGAGQVPWNQKVTHTRAHSPLWGRNCSQRLQFIFIWGFTEKPEPAVFRVGDVNIVCT

SEQ ID NO: 803981 - protein, 124 aa, Homo sapiens
MLDGRQRRGIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKEWQDFLDSLQKRKMEVE

SEQ ID NO: 803982 - protein, 154 aa, Homo sapiens; identical to SEQ ID NO: 803977

SEQ ID NO: 803983 - protein, 208 aa, Homo sapiens
MPKAKGKTRRQKFGYSVNRKRLNRNARRKAAPRDRMVRGLGFRVAVGLGRDGPRDDGSAMSLFAGSSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKAMARDEKNYYQDTPKQIRSKINVYKRFYPAEWQDFLDSLQKRKMEVE

SEQ ID NO: 803984 - protein, 124 aa, Homo sapiens; identical to SEQ ID NO: 803981

SEQ ID NO: 803985 - protein, 154 aa, Homo sapiens; identical to SEQ ID NO: 803977

SEQ ID NO: 803986 - protein, 130 aa, Homo sapiens
MVQRGPPESQGRESPCPGHSSRRKSGLRPQPPGEGHERGGETNKLSLVRRRKCSLHPGSRSAQHGSATKGLHFPKCPQSLVHAFRKEFVTRGLRDRGSVFELLVRWSARCPRPRAKPGGRSLVTVSTESV

SEQ ID NO: 803987 - protein, 102 aa, Homo sapiens
TQDIYVWGRTTRLGNDCNYVEVSSCEEVSMAPASGRPMTTKHHGTSVSIFKFPSSVSFFGCIPLCLLQECWAPAAVVDGPQIWLVQAPLLQGFKRPLQSVCF

SEQ ID NO: 803988 - protein, 193 aa, Homo sapiens
TPGGIMKEPRKMFLSKFAEKMHIEAEEEVSEALHDVDFQQLKIENAQFLETIEARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 803989 - protein, 80 aa, Homo sapiens
ASRVSPVVNKRLRKQLAEFRAPQVMTYVREKILNADLEKSIRMWERKVEIAEMSLKGHRKAWNRMKITNEQLQADYLAGK

SEQ ID NO: 803990 - protein, 224 aa, Homo sapiens
MSAVGAATPYLHHPGDSHSGRVSFLGAQLPPEVAAMARLLGDLDRSTFRKLLKFVVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARSLQPSVLMQLKLSDGSAYRFEVPTAKFQELRYSVALVLKEMADLEKRCERRLQD

SEQ ID NO: 803991 - protein, 268 aa, Homo sapiens
RKWLSGRFRGPGPLLAASAGDCRRQASASGTDLLGWLIKEEAAAMSAVGAATPYLHHPGDSHSGRVSFLGAQLPPEVAAMARLLGDLDRSTFRKLLKFVVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARSLQPSVLMQLKLSDGSAYRFEVPTAKFQELRYSVALVLKEMADLEKRCERRLQD

SEQ ID NO: 803992 - protein, 224 aa, Homo sapiens; identical to SEQ ID NO: 803990

SEQ ID NO: 803993 - protein, 224 aa, Homo sapiens; identical to SEQ ID NO: 803990

SEQ ID NO: 803994 - protein, 224 aa, Homo sapiens; identical to SEQ ID NO: 803990

SEQ ID NO: 803995 - protein, 224 aa, Homo sapiens; identical to SEQ ID NO: 803990

SEQ ID NO: 803996 - protein, 268 aa, Homo sapiens; identical to SEQ ID NO: 803991

SEQ ID NO: 803997 - protein, 268 aa, Homo sapiens; identical to SEQ ID NO: 803991

SEQ ID NO: 803998 - protein, 268 aa, Homo sapiens; identical to SEQ ID NO: 803991

SEQ ID NO: 803999 - protein, 201 aa, Homo sapiens
MSAVGAATPYLHHPGDSHSGRVSFLGAQLPPEVAAMARLLGDLDRSTFRKLLKFVVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARSLQPSVLMQLKLSDGSAYADLEKRCERRLQD

SEQ ID NO: 804000 - protein, 207 aa, Homo sapiens
MSAVGAATPYLHHPGDSHSGRVSFLGAQLPPEVAAMARLLGDLDRSTFRKLLKFVVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARSRFEVPTAKFQELRYSVALVLKEMADLEKRCERRLQD

SEQ ID NO: 804001 - protein, 225 aa, Homo sapiens
MSAVGAATPYLHHPGDSHSGRVSFLGAQLPPEVAAMARLLGDLDRSTFRKLLKFVVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARSLQPSVLMQLKLSDGSAYRFEVPTAKFQELRYSVALVLKEMTGISHHTRPEVGYS

SEQ ID NO: 804002 - protein, 163 aa, Homo sapiens
RLGGVRVGRGKGWGFDPFLPLTGPTPPPRGRALKMLSSSSVQGGAEGRMQREKQVSSWNPRNLQPLPTHLPSRISIPQPLAPSTPPAPPTRPYSPPAPGEGWGRAAVSQPRAARLTWPSLRWGRRPRLPGPPQLRQAPQGPGPSGRALRSLSSSAPCGPENSP

SEQ ID NO: 804003 - protein, 199 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 804004 - protein, 199 aa, Homo sapiens; identical to SEQ ID NO: 804003

SEQ ID NO: 804005 - protein, 199 aa, Homo sapiens; identical to SEQ ID NO: 804003

SEQ ID NO: 804006 - protein, 199 aa, Homo sapiens; identical to SEQ ID NO: 804003

SEQ ID NO: 804007 - protein, 199 aa, Homo sapiens; identical to SEQ ID NO: 804003

SEQ ID NO: 804008 - protein, 199 aa, Homo sapiens; identical to SEQ ID NO: 804003

SEQ ID NO: 804009 - protein, 253 aa, Homo sapiens
MSWIPFKIGQPKKQIVPKTVERDFEREYGKLQQLEEQTRRLQKDMKKSTDADLAMSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQVVYYSEMHKIFGDLSHQLDQPGHSDEQRERENEAKLSELRALSIVADD

SEQ ID NO: 804010 - protein, 253 aa, Homo sapiens; identical to SEQ ID NO: 804009

SEQ ID NO: 804011 - protein, 199 aa, Homo sapiens
MSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQVVYYSEMHKIFGDLSHQLDQPGHSDEQRERENEAKLSELRALSIVADD

SEQ ID NO: 804012 - protein, 392 aa, Homo sapiens
MASSPTDNCCHCLWIRNHLTEGTARLRALHGQVKRSLGVSVEGRKRPQRFPSSPVAACVSKRLARARESPARETPRRARSSRRVNAPGSASQPPLPGREAGFTSLPGDWLNPEVTLEKRVVAEDPGGRRRFGTMSWIPFKIGQPKKQIVPKTVERDFEREYGKLQQLEEQTRRLQKDMKKSTDADLAMSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQEEATGCQAPACPGGADGRPGMPFNQAALLGAVDCLLGPSLPLARPAAISHGEVS

SEQ ID NO: 804013 - protein, 149 aa, Homo sapiens
MSWIPFKIGQPKKQIVPKTVERDFEREYGKLQQLEEQTRRLQKDMKKSTDADLAMSKSAVKISLDLLSNPLCEQDQDLLNMVTALDTAMKRMDAFNQEKVNQIQKTVIEPLKKRNQLFWSWVTSEWPQSHELPGLRSLILDTAGLWLAW

SEQ ID NO: 804014 - protein, 199 aa, Homo sapiens; identical to SEQ ID NO: 804011

SEQ ID NO: 804015 - protein, 209 aa, Homo sapiens
MKKSTDADLAMSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQVVYYSEMHKIFGDLSHQLDQPGHSDEQRERENEAKLSELRALSIVADD

SEQ ID NO: 804016 - protein, 199 aa, Homo sapiens; identical to SEQ ID NO: 804011

SEQ ID NO: 804017 - protein, 191 aa, Homo sapiens
MRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804018 - protein, 529 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804019 - protein, 529 aa, Homo sapiens; identical to SEQ ID NO: 804018

SEQ ID NO: 804020 - protein, 529 aa, Homo sapiens; identical to SEQ ID NO: 804018

SEQ ID NO: 804021 - protein, 474 aa, Homo sapiens [sequence omitted]

SEQ ID NO: 804022 - protein, 529 aa, Homo sapiens; identical to SEQ ID NO: 804018

SEQ ID NO: 804023 - protein, 474 aa, Homo sapiens [sequence omitted]

SEQ ID NO: 804024 - protein, 390 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKVPLSRRLW

SEQ ID NO: 804025 - protein, 474 aa, Homo sapiens [sequence omitted]

SEQ ID NO: 804026 - protein, 458 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGPEQGLLPKGCGATS

SEQ ID NO: 804027 - protein, 540 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRVSKLWGLRKAEQARSRAGEPLRERKTIINNS

SEQ ID NO: 804028 - protein, 537 aa, Homo sapiens
FSASEVTSAWQVLYLPVGLASCITTFKIHPRAIWETFFSRSPCVLASPPRSSRVWYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804029 - protein, 474 aa, Homo sapiens [sequence omitted]

SEQ ID NO: 804030 - protein, 474 aa, Homo sapiens [sequence omitted]

SEQ ID NO: 804031 - protein, 474 aa, Homo sapiens [sequence omitted]

SEQ ID NO: 804032 - protein, 459 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYERLSHFRCELLRRGVQAQPLNVGFCEQEFEQT

SEQ ID NO: 804033 - protein, 419 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKDSGNHLRVGGFRTIRREASASAFCPEKEQARGKTPCP

SEQ ID NO: 804034 - protein, 328 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPGPEQGLLPKGCGATS

SEQ ID NO: 804035 - protein, 393 aa, Homo sapiens
MMTSVYSSLRLSGELSEFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804036 - protein, 360 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTYP

SEQ ID NO: 804037 - protein, 393 aa, Homo sapiens; identical to SEQ ID NO: 804035

SEQ ID NO: 804038 - protein, 350 aa, Homo sapiens
DAWVRPTRSALDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804039 - protein, 337 aa, Homo sapiens
DLEDPPNWIHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804040 - protein, 300 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPAQSRGCCRKAVEQQVDI

SEQ ID NO: 804041 - protein, 196 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDSSSWSPSTSRRCWTSSLLMARAMWCGRRCLIIK

SEQ ID NO: 804042 - protein, 254 aa, Homo sapiens
MAGVNRRGSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804043 - protein, 298 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRAGDFCQQEVFDNKVIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804044 - protein, 275 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGPEQGLLPKGCGATS

SEQ ID NO: 804045 - protein, 103 aa, Homo sapiens
MTPNWKDFYVVEPLAFDSTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 804046 - protein, 283 aa, Homo sapiens
MMTSVYSSLRLSGELSEFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKDSGNHLRVGGFRTIRREASASAFCPEKEQARGKTPCP

SEQ ID NO: 804047 - protein, 112 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLAQSRGCCRKAVEQQVDI

SEQ ID NO: 804048 - protein, 976 aa, Homo sapiens
DAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKMGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFR

SEQ ID NO: 804049 - protein, 205 aa, Homo sapiens
VIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKG

SEQ ID NO: 804050 - protein, 127 aa, Homo sapiens
FFKFLIINMIFFTAVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIGKPGNHSFF

SEQ ID NO: 804051 - protein, 142 aa, Homo sapiens
SLAFPKRSGRTKALTQLLLPIALAQCSEMFTLKYMVSDLLSYIKKASSVCLRIAFSIFSVDSFPDRPSPPRNLAVTDIKAESCYLTWDAPLDNGGSEITHYVIDKRDASRKKAEWEEVTNTAVEKRYGVNSSEYFLIHIKST

SEQ ID NO: 804052 - protein, 151 aa, Homo sapiens
RWKKKLSSSTQEQANNDFFLLAELLSDYIRLLANSRAAFDQRMKTCQRWQDAKATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 804053 - protein, 123 aa, Homo sapiens
FPSLAKSRVAFNQAIKKCKRCQIPKPPFKKNGRPKLGFCGPTNLINVHQAKGQVLRWESRVTQYERDFERISTVVRKEVIRFEKEKSKDFKNHVIKYLETLLYSQQQLAKYWEAFLPEAKAIS

SEQ ID NO: 804054 - protein, 151 aa, Homo sapiens; identical to SEQ ID NO: 804052

SEQ ID NO: 804055 - protein, 151 aa, Homo sapiens; identical to SEQ ID NO: 804052

SEQ ID NO: 804056 - protein, 151 aa, Homo sapiens; identical to SEQ ID NO: 804052

SEQ ID NO: 804057 - protein, 151 aa, Homo sapiens; identical to SEQ ID NO: 804052

SEQ ID NO: 804058 - protein, 151 aa, Homo sapiens; identical to SEQ ID NO: 804052

SEQ ID NO: 804059 - protein, 210 aa, Homo sapiens
AEHPAMAASTASQRPLKGILKDNTSTTSSMVASAEHPRGSVHEQLSKKSQKWDEMNILATYRPADKDYGLMKIDEPSTPYHSTMGDDEDACSDTETTEAMATDSLAKNLAAAEGLEPKYQVQEQESSGEEDSDLSPEEREKKRQFEMRRTLHYNEGLNIKLARQLISKDLHDDDKVEEMLETAHGESMNTEESNQGSTASDQQQNKSRSS

SEQ ID NO: 804060 - protein, 425 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804061 - protein, 410 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMELVLDH

SEQ ID NO: 804062 - protein, 284 aa, Homo sapiens
GRPRRAVGAWAEPRPRHGLTVRAGPSLPSAVPAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTIWPVGISAGPKGGKVGECDIFKGIRDYFVPGFIHSFVGQWCDRTMIGRRYNFPALL

SEQ ID NO: 804063 - protein, 69 aa, Homo sapiens
ALPLADVGAKVRESALALGAQETIEAARTERALAASPPLPQRSTPGFPRLACPPWPTRKQPSTTQWKNE

SEQ ID NO: 804064 - protein, 87 aa, Homo sapiens
TSSCGVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804065 - protein, 425 aa, Homo sapiens; identical to SEQ ID NO: 804060

SEQ ID NO: 804066 - protein, 425 aa, Homo sapiens; identical to SEQ ID NO: 804060

SEQ ID NO: 804067 - protein, 451 aa, Homo sapiens
MYETGVLIGTEDVTLDPRIPPARLPAMADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804068 - protein, 452 aa, Homo sapiens
GRPRRAVGAWAEPRPRHGLTVRAGPSLPSAVPAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804069 - protein, 534 aa, Homo sapiens
RQFPGTDFGRSWRSQRWGPRPVFVSLPASDIGFSASVPSVGTPLPTHKARSSGLLVGLVSFGAHERAPKAWLAPWPGTGNGVFGGDGPRSFGAAKVESVDASAVGIYDKSPPFHAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804070 - protein, 425 aa, Homo sapiens; identical to SEQ ID NO: 804060

SEQ ID NO: 804071 - protein, 502 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMMVSHFFTQAGVQWCNLGSLQLPPPRFDRFSCLSLLSSWDYRQRTFIMMKTLKEAWIQKDKGPRYVFTCCDFRLPFFLLNPESDLTLVLRQTLFSYPSI

SEQ ID NO: 804072 - protein, 415 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMVVSGYFHPRVE

SEQ ID NO: 804073 - protein, 386 aa, Homo sapiens
VHWPVANCRLDWRKSSPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804074 - protein, 435 aa, Homo sapiens
SVYTRNLKEGNPNEVNMVTQKSVVKELEWKPKLLSKWEKKRKHESKQITQGNPGQMLTLALSRKPPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804075 - protein, 456 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGELSAVVRSHCSLRLLGSSDSPASASWVAGITEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804076 - protein, 293 aa, Homo sapiens
MPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804077 - protein, 340 aa, Homo sapiens
TLQDLLYQADAYTTTVRKEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804078 - protein, 327 aa, Homo sapiens
NQLGPLLPTTLTLTGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804079 - protein, 362 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804080 - protein, 425 aa, Homo sapiens; identical to SEQ ID NO: 804060

SEQ ID NO: 804081 - protein, 411 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMWARKTFF

SEQ ID NO: 804082 - protein, 416 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMGKGLVIYFGEVK

SEQ ID NO: 804083 - protein, 152 aa, Homo sapiens
VSTQSRHYGRDSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 804084 - protein, 304 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVACGNWA

SEQ ID NO: 804085 - protein, 87 aa, Homo sapiens; identical to SEQ ID NO: 804064

SEQ ID NO: 804086 - protein, 257 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAGPKGGKVGECDIFKGIRDYFVPGFIHSFVGQWCDRTMIGRRYNFPALL

SEQ ID NO: 804087 - protein, 808 aa, Homo sapiens
GPRRLGESNVEQGGGWCGVPSGLTPNRRPSRTVPRRCREPGAALCGLGETRGVCLSPLFYKMWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMRMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804088 - protein, 786 aa, Homo sapiens
GPRRLGESNVEQGGGWCGVPSGLTPNRRPSRTVPRRCREPGAALCGLGETRGVCLSPLFYKMWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804089 - protein, 735 aa, Homo sapiens
GPAGSVNRTLSRAVGGAECRAASPPTVGPVGRFRGVAGSRARLCVDSEKRGFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804090 - protein, 874 aa, Homo sapiens
GPRRLGESNVEQGGGWCGVPSGLTPNRRPSRTVPRRCREPGAALCGLGETRGVCLSPLFYKMWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMRMSQGVLGEKTPILNVLEAGRPGQPRLLASAGASVWEARVSVTNFFYSSQCLEVGALFHAVEHDFSLNLWQVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804091 - protein, 608 aa, Homo sapiens
MAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804092 - protein, 757 aa, Homo sapiens
GPAGSVNRTLSRAVGGAECRAASPPTVGPVGRFRGVAGSRARLCVDSEKRGFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMRMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804093 - protein, 630 aa, Homo sapiens
MAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMRMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804094 - protein, 786 aa, Homo sapiens; identical to SEQ ID NO: 804088

SEQ ID NO: 804095 - protein, 347 aa, Homo sapiens
PWRGGGCTSPATLGAARGAVGIGKEGQYQPLIASLTWGLVPLSQAQEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804096 - protein, 293 aa, Homo sapiens
SNPSGHGSHGLPITPFTLLRCHQLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804097 - protein, 288 aa, Homo sapiens
RERERRLVPHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 804098 - protein, 786 aa, Homo sapiens; identical to SEQ ID NO: 804088

SEQ ID NO: 804099 - protein, 786 aa, Homo sapiens; identical to SEQ ID NO: 804088

SEQ ID NO: 804100 - protein, 786 aa, Homo sapiens; identical to SEQ ID NO: 804088

SEQ ID NO: 804101 - protein, 582 aa, Homo sapiens
GPRRLGESNVEQGGGWCGVPSGLTPNRRPSRTVPRRCREPGAALCGLGETRGVCLSPLFYKMWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKTRSSFMNTQQPEQVPALPSASPAGVPGQLSVGGPPEPRARAGACMSLSMTASRLALGTVLCGNPPL

SEQ ID NO: 804102 - protein, 219 aa, Homo sapiens
GPRRLGESNVEQGGGWCGVPSGLTPNRRPSRTVPRRCREPGAALCGLGETRGVCLSPLFYKMWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIGKTCAPACSCCHAGKN

SEQ ID NO: 804103 - protein, 105 aa, Homo sapiens
MLTPFLSCLCSIKYMGVFTYVLVLGVAAVHAWHLLGDQTLSNVGADVQCCMRPACMGQMRMSQGVLGEKTPILNVLEAGRPGQPRLLASAGASVWEARVSVTNFF

SEQ ID NO: 804104 - protein, 136 aa, Homo sapiens
RGSLKECGPPEDSLHSSSITSLPPVAAGIPEDSGPGSTQSSSRPGNTSSSSRPPPPPPPPPPRRFLLRLPASFAPSRPRSASGPPAGQLLSGAPTQAHGSMKQEEEAERERSRPPQPRLGQDKSKTIFLLLSVMMY

SEQ ID NO: 804105 - protein, 136 aa, Homo sapiens; identical to SEQ ID NO: 804104

SEQ ID NO: 804106 - protein, 136 aa, Homo sapiens; identical to SEQ ID NO: 804104

SEQ ID NO: 804107 - protein, 136 aa, Homo sapiens; identical to SEQ ID NO: 804104

SEQ ID NO: 804108 - protein, 136 aa, Homo sapiens; identical to SEQ ID NO: 804104

SEQ ID NO: 804109 - protein, 136 aa, Homo sapiens; identical to SEQ ID NO: 804104

SEQ ID NO: 804110 - protein, 136 aa, Homo sapiens; identical to SEQ ID NO: 804104

SEQ ID NO: 804111 - protein, 136 aa, Homo sapiens; identical to SEQ ID NO: 804104

SEQ ID NO: 804112 - protein, 136 aa, Homo sapiens; identical to SEQ ID NO: 804104

SEQ ID NO: 804113 - protein, 136 aa, Homo sapiens; identical to SEQ ID NO: 804104

SEQ ID NO: 804114 - protein, 136 aa, Homo sapiens; identical to SEQ ID NO: 804104

SEQ ID NO: 804115 - protein, 781 aa, Homo sapiens
PWRRTGRSRGSQKRWEKRRRTPRRRRRRRPGSERSRKVQRRLRAPSPGLAADEPAGPLRGAAQPGRLWSRGSRRPPGARDPPGRCARVTPPPRAVPAPGSQLPATADRARRPRRRKKPGPRSLPRTAALHPAAQRSRLPPAPARPGCSRLLPAMGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 804116 - protein, 591 aa, Homo sapiens
MGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 804117 - protein, 781 aa, Homo sapiens; identical to SEQ ID NO: 804115

SEQ ID NO: 804118 - protein, 777 aa, Homo sapiens
PWRRTGRSRGSQKRWEKRRRTPRRRRRRRPGSERSRKVQRRLRAPSPGLAADEPAGPLRGAAQPGRLWSRGSRRPPGARDPPGRCARVTPPPRAVPAPGSQLPATADRARRPRRRKKPGPRSLPRTAALHPAAQRSRLPPAPARPGCSRLLPAMGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPVQQPRPKKADKKTETLHANLLPWLLWKRNNPIGYPCIFIHS

SEQ ID NO: 804119 - protein, 353 aa, Homo sapiens
PWRRTGRSRGSQKRWEKRRRTPRRRRRRRPGSERSRKVQRRLRAPSPGLAADEPAGPLRGAAQPGRLWSRGSRRPPGARDPPGRCARVTPPPRAVPAPGSQLPATADRARRPRRRKKPGPRSLPRTAALHPAAQRSRLPPAPARPGCSRLLPAMGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVRAPV

SEQ ID NO: 804120 - protein, 499 aa, Homo sapiens
MSFGSEHYLCSSSSYRKVFGDGSRLSARLSGAGGAGGFRSQSLSRSNVASSAACSSASSLGLGLAYRRPPASDGLDLSQAAARTNEYKIIRTNEKEQLQGLNDRFAVFIEKVHQLETQNRALEAELAALRQRHAEPSRVGELFQRELRDLRAQLEEASSARSQALLERDGLAEEVQRLRARCEEESRGREGAERALKAQQRDVDGATLARLDLEKKVESLLDELAFVRQVHDEEVAELLATLQASSQAAAEVDVTVAKPDLTSALREIRAQYESLAAKNLQSAEEWYKSKFANLNEQAARSTEAIRASREEIHEYRRQLQARTIEIEGLRGANESLERQILELEERHSAEVAGYQDSIGQLENDLRNTKSEMARHLREYQDLLNVKMALDIEIAAYRKLLEGEETRFSTSGLSISGLNPLPNPSYLLPPRILSATTSKVSSTGLSLKKEEEEEEASKVASKKTSQIGESFEEILEETVISTKKTEKSNIEETTISSQKI

SEQ ID NO: 804121 - protein, 499 aa, Homo sapiens; identical to SEQ ID NO: 804120

SEQ ID NO: 804122 - protein, 187 aa, Homo sapiens
RGREGAERALKAQQRDVDGATLARLDLEKKVESLLDELAFVRQVHDEEVAELLATLQASSQAAAEVDVTVAKPDLTSALREIRAQYESLAAKNLQSAEEWYKSKFANLNEQAARSTEAIRASREEIHEYRRQLQARTIEIEGLRGANESLERQILELEERHSAEVAGYQVRAGAGRGEGCPALFRAY

SEQ ID NO: 804123 - protein, 92 aa, Homo sapiens
TSLHFPKMKLEKKQSIQIWKWLLEGSGTHSSNMQFITAHQSWQATGHSGALSKSACRDTHSRPHKKQWPQVQTEENDCTRNETLRPGREMFR

SEQ ID NO: 804124 - protein, 309 aa, Homo sapiens
MLFEKSPKTKQQAQCPFLLSFPGIGPPSQPTPWGSQGDSWRGGAQGGLRGGGALGPPAHAPGSPADCGLAPAALTRIVGGSAAGRGEWPWQVSLWLRRREHRCGAVLVAERWLLSAAHCFDVYGDPKQWAAFLGTPFLSGAEGQLERVARIYKHPFYNLYTLDYDVALLELAGPVRRSRLVRPICLPEPAPRPPDGTRCVITGWGSVREGGSMARQLQKAAVRLLSEQTCRRFYPVQISSRMLCAGFPQGGVDSCSGDAGGPLACREPSGRWVLTGVTSWGYGCGRPHFPGVYTRVAAVRGWIGQHIQE

SEQ ID NO: 804125 - protein, 122 aa, Homo sapiens [sequence omitted]

SEQ ID NO: 804126 - protein, 560 aa, Homo sapiens
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRNMFPANLVEATFKQYRTKTTPVVKSPKVAPEEAPPRRILIYGVQEENGSHVQNFALDLTPPPEVVYKSEPGTSDGMNVLGIVFFSATMGIMLGRMGDSGAPLVSFCQCLNESVMKIVAVAVWYFPFGIVFLIAGKILEMDDPRAVGKKLGFYSVTVVCGLVLHGLFILPLLYFFITKKNPIVFIRGILQALLIALATSSSSATLPITFKCLLENNHIDRRIARFVLPVGATINMDGTALYEAVAAIFIAQVNNYELDFGQIITISITATAASIGAAGIPQAGLVTMVIVLTSVGLPTDDITLIIAVDWALDRFRTMINVLGDALAAGIMAHICRKDFARDTGTEKLLPCETKPVSLQEIVAAQQNGCVKSVAEASELTLGPTCPHHVPVQVERDEELPAASLNHCTIQISELETNV

SEQ ID NO: 804127 - protein, 158 aa, Homo sapiens
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRQKEESWRNGPKGPG

SEQ ID NO: 804128 - protein, 560 aa, Homo sapiens; identical to SEQ ID NO: 804126

SEQ ID NO: 804129 - protein, 260 aa, Homo sapiens
AGAALQRHKHSWRGGCLGRGELPDRGPSHPGGGCWADTGPSNRSSATLPITFKCLLENNHIDRRIARFVLPVGATINMDGTALYEAVAAIFIAQVNNYELDFGQIITISITATAASIGAAGIPQAGLVTMVIVLTSVGLPTDDITLIIAVDWALDRFRTMINVLGDALAAGIMAHICRKDFARDTGTEKLLPCETKPVSLQEIVAAQQNGCVKSVAEASELTLGPTCPHHVPVQVERDEELPAASLNHCTIQISELETNV

SEQ ID NO: 804130 - protein, 477 aa, Homo sapiens
AFLQRGDKEGGGRLAALSAARSAVQGLRSPRAGAGVGVGPGAQETFRGRGCGSAGFPTGRVSRQLPESGGARGGPAFHKVHAYSRAAGSPPAAQARSLSGVTRPPGPRDARGRQGRTTSLRPCPCAPPGLPRGAAQPTRPSWPEGAAPGLAGKPEPPGPSRAFSDFPPGVLDLLRPSWASSGFLDPPQAFPEASRPFPGPLQAELSATWPVGLWDPGPGPPASTLHSHRLLTSSQEHRPDEHAGFRTNTWAIVTLRMPGNEEIRKLVPLHLGDGGKLARTTAHPIHSSCSQFVLLCDTTSITRTASSSSSVIKFSLLDKCKKPENCAQPEVLCRPFEMLSNLHELLPNHLMETLYSRKSEEDKKKCENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTGKSQCLLGISEPT

SEQ ID NO: 804131 - protein, 475 aa, Homo sapiens
AFLQRGDKEGGGRLAALSAARSAVQGLRSPRAGAGVGVGPGAQETFRGRGCGSAGFPTGRVSRQLPESGGARGGPAFHKVHAYSRAAGSPPAAQARSLSGVTRPPGPRDARGRQGRTTSLRPCPCAPPGLPRGAAQPTRPSWPEGAAPGLAGKPEPPGPSRAFSDFPPGVLDLLRPSWASSGFLDPPQAFPEASRPFPGPLQAELSATWPVGLWDPGPGPPASTLHSHRLLTSSQEHRPDEHAGFRTNTWAIVTLRMPGNEEIRKLVPLHLGDGGKLARTTAHPIHSSCSQFVLLCDTTSITRTASSSSSVIKFSLLDKCKKPENCAQPEVLCRPFEMLSNLHELLPNHLMETLYSRKSEEDKKKCENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTVKSHETSRMNR

SEQ ID NO: 804132 - protein, 349 aa, Homo sapiens
AFLQRGDKEGGGRLAALSAARSAVQGLRSPRAGAGVGVGPGAQRDLPGPGLRLRGLPHRPGLPATTRERGRPGRPGVPQGPRVFAGRGVAAGRPGAEPLGGHPAAGPAGRTGPARGGQQASGPVPAPRPASPAGLRSPLGHPGLKGPPPASRESLSLPGLLGPSRTFPQASWTFFGLPGPPRASLTLPRPSPRPPGPSLGLSRLSSPRHGQWASGTRGPAHPPPPPFPPPAHIKPGAPPGENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTVKSHETSRMNR

SEQ ID NO: 804133 - protein, 456 aa, Homo sapiens
AFLQRGDKEGGGRLAALSAARSAVQGLRSPRAGAGVGVGPGAQETFRGRGCGSAGFPTGRVSRQLPESGGARGGPAFHKVHAYSRAAGSPPAAQARSLSGVTRPPGPRDARGRQGRTTSLRPCPCAPPGLPRGAAQPTRPSWPEGAAPGLAGKPEPPGPSRAFSDFPPGVLDLLRPSWASSGFLDPPQAFPEASRPFPGPLQAELSATWPVGLWDPGPGPPASTLHSHRLLTSSQEHRPDEHAGFRTNTWAIVTLRMPGNEEIRKLVPLHLGDGGKLARTTAHPIHSSCSQFVLLCDTTSITRTASSSSSVIKFSLLDKCKKPENCAQPEVLCRPFEMLSNLHELLPNHLMETLYSRKSEEDKKKCENPELSGLERILARHQLPKEINLTPKPNRMPPWKRKIINNVTDGWKKCHLLKRNTKEPPMSTIVVREVLFTFFGIRSGIQATLILLLMLS

SEQ ID NO: 804134 - protein, 276 aa, Homo sapiens
MSPCSGKSGWQGPRVVQRVPGDSAVPRGMHGSFIIVTRHGWGLKAAILMTQGTLEAQVLLMAEPPVGASRERELRGPMAWSPCGLAQPSSSRPSLTRACRRNLPRVSGQQPVPAGVPPEPPAQQLRPREAQGAEDPALSVQPRLLLLPAHPQTQLCLHPGSCSYAGTPRSLCTGTDVTGRYGGEQELGTHTGLGDRVSAGPSRLLGPRCKGMAPRPGGSTTGFRNEDTARCGTAGGEEEDGEPSNPQRPEGSAAHENTGRAAEGKGDNEKGQQHRT

SEQ ID NO: 804135 - protein, 655 aa, Homo sapiens
MSPCSGKSGWQGPRVVQRVPGDSAVPRGMHGSFIIVTRHGWGLKAAILMTQGTLEAQVLLMAEPPVGASRERELRGPMAWSPCGLAQPSSSRPSLTRACRRNLPRVSGQQPVPAGVPPEPPAQQLRPREAQGAEDPALSVQPRLLLLPAHPQTQLCLHPGSCSFCRAPRSSAREQLVPEGSRGRAGLGEHPVLGHRVAAGSLPASGDPACHRHGLPGQAAQHPPGFGYSKEHGRTGSAGEAFLSTIQKAAEVVASAMRPGPESPSTRRLLPRGDTYQPAMMPSASHGPPTLGNLLPGAIPGPRAVRHQPGQAGGGWDELDSGPSSQNSSQNSDLSRVSDSGSHSGSDSHSGASREPGDLAERVEVVALSDCQQELSLVRTVTRGPRAFLSREEAQHFIKACRCGLLNCEAVLQLLTCHLRGTSECTQLRALCAIASLGSSDLLPQEHILLRTRPWLQELSMGSPGPVTNKATKILRHFEASCGQLSPARGTSAEPGPTAALPGPSDLLTDAVPLPGSQVFLQPLSSTPVSSRSPAPSSGMPSSPVPTPPPDASPIPAPGDPSEAEARLAESRRWRPERIPGGTDSPKRGPSSCVWSRDSLFAGMELVACPRLVGAGAAAGESCPDAPRAPQTSSQRTAAKEPPGSEPSAFAFLNA

SEQ ID NO: 804136 - protein, 443 aa, Homo sapiens
MGSQARPHSTLQGFGYSKEHGRTGSAGEAFLSTIQKAAEVVASAMRPGPESPSTRRLLPRGDTYQPAMMPSASHGPPTLGNLLPGAIPGPRAVRHQPGQAGGGWDELDSGPSSQNSSQNSDLSRVSDSGSHSGSDSHSGASREPGDLAERVEVVALSDCQQELSLVRTVTRGPRAFLSREEAQHFIKACRCGLLNCEAVLQLLTCHLRGTSECTQLRALCAIASLGSSDLLPQEHILLRTRPWLQELSMGSPGPVTNKATKILRHFEASCGQLSPARGTSAEPGPTAALPGPSDLLTDAVPLPGSQVFLQPLSSTPVSSRSPAPSSGMPSSPVPTPPPDASPIPAPGDPSEAEARLAESRRWRPERIPGGTDSPKRGPSSCVWSRDSLFAGMELVACPRLVGAGAAAGESCPDAPRAPQTSSQRTAAKEPPGSEPSAFAFLNA

SEQ ID NO: 804137 - protein, 588 aa, Homo sapiens
MVGALVPFQLPILLKGTSDDDVPCPGYLFEEIAKISHESPGSSQCLLEYLLSRLHSSSGHGKLKVLKILLYLCSHGSSFFLLILKRNSAFIQEAAAFAGPPDPLHGNSLYQKVRAAAQDLGSTLFSDTVLPLAPSQPLGTPPATGMGSQARPHSTLQGFGYSKEHGRTGSAGEAFLSTIQKAAEVVASAMRPGPESPSTRRLLPRGDTYQPAMMPSASHGPPTLGNLLPGAIPGPRAVRHQPGQAGGGWDELDSGPSSQNSSQNSDLSRVSDSGSHSGSDSHSGASREPGDLAERVEVVALSDCQQELSLVRTVTRGPRAFLSREEAQHFIKACRCGLLNCEAVLQLLTCHLRGTSECTQLRALCAIASLGSSDLLPQEHILLRTRPWLQELSMGSPGPVTNKATKILRHFEASCGQLSPARGTSAEPGPTAALPGPSDLLTDAVPLPGSQVFLQPLSSTPVSSRSPAPSSGMPSSPVPTPPPDASPIPAPGDPSEAEARLAESRRWRPERIPGGTDSPKRGPSSCVWSRDSLFAGMELVACPRLVGAGAAAGESCPDAPRAPQTSSQRTAAKEPPGSEPSAFAFLNA

SEQ ID NO: 804138 - protein, 655 aa, Homo sapiens; identical to SEQ ID NO: 804135

SEQ ID NO: 804139 - protein, 443 aa, Homo sapiens; identical to SEQ ID NO: 804136

SEQ ID NO: 804140 - protein, 443 aa, Homo sapiens; identical to SEQ ID NO: 804136

SEQ ID NO: 804141 - protein, 527 aa, Homo sapiens
MAAAPPLRDRLSFLHRLPILLKGTSDDDVPCPGYLFEEIAKISHESPGSSQCLLEYLLSRLHSSSGHGKLKVLKILLYLCSHGSSFFLLILKRNSAFIQEAAAFAGPPDPLHGNSLYQKVRAAAQDLGSTLFSDTVLPLAPSQPLGTPPATGMGSQARPHSTLQGFGYSKEHGRTAVRHQPGQAGGGWDELDSGPSSQNSSQNSDLSRVSDSGSHSGSDSHSGASREPGDLAERVEVVALSDCQQELSLVRTVTRGPRAFLSREEAQHFIKACRCGLLNCEAVLQLLTCHLRGTSECTQLRALCAIASLGSSDLLPQEHILLRTRPWLQELSMGSPGPVTNKATKILRHFEASCGQLSPARGTSAEPGPTAALPGPSDLLTDAVPLPGSQVFLQPLSSTPVSSRSPAPSSGMPSSPVPTPPPDASPIPAPGDPSEAEARLAESRRWRPERIPGGTDSPKRGPSSCVWSRDSLFAGMELVACPRLVGAGAAAGESCPDAPRAPQTSSQRTAAKEPPGSEPSAFAFLNA

SEQ ID NO: 804142 - protein, 254 aa, Homo sapiens
PGGSGADREGTWIMAAAPPLRDRLSFLHRVSEGGPPGPRSHGSSRAPHSPDSPRAGAIDLASPRRVAAPGPFARADAPELPARRAVPGPSKPGLPSRTRRAQGRWAQPDPGGTNRPRPAFSGLRREGRSGGPGGRGAAVSVLLAPRWAGSPPSSLTVAFQRTPVLERHPWVAENTDVSKGQRRTHHCKPLLVNPLRSRGRGEFPGVVLSKLPSFVSPELSWAGPQRGLGGPRTRPWAARSHARVGQGSQCKVST

SEQ ID NO: 804143 - protein, 443 aa, Homo sapiens; identical to SEQ ID NO: 804136

SEQ ID NO: 804144 - protein, 443 aa, Homo sapiens; identical to SEQ ID NO: 804136

SEQ ID NO: 804145 - protein, 254 aa, Homo sapiens; identical to SEQ ID NO: 804142

SEQ ID NO: 804146 - protein, 708 aa, Homo sapiens
GAAAGAARGGAAPAARSGPARPGAAAAAAAAAAATPEPVGAVREAAAEARPQRREAWGPEVAAAAMPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 804147 - protein, 708 aa, Homo sapiens; identical to SEQ ID NO: 804146

SEQ ID NO: 804148 - protein, 439 aa, Homo sapiens
GAAAGAARGGAAPAARSGPARPGAAAAAAAAAAATPEPVGAVREAAAEARPQRREAWGPEVAAAAMPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHKVSDCELAAEFFG

SEQ ID NO: 804149 - protein, 708 aa, Homo sapiens; identical to SEQ ID NO: 804146

SEQ ID NO: 804150 - protein, 754 aa, Homo sapiens
GAAAGAARGGAAPAARSGPARPGAAAAAAAAAAATPEPVGAVREAAAEARPQRREAWGPEVAAAAMPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDEGLSQFCPLHGKAGLTALPLYKACGLIVFGQLINLILLCNTFYVTFLFPLETLQILTVGMISSGVDWTAWGGGRSGGSEQSPACSRQLLLLPHAYVPQMQVS

SEQ ID NO: 804151 - protein, 712 aa, Homo sapiens
GAAAGAARGGAAPAARSGPARPGAAAAAAAAAAATPEPVGAVREAAAEARPQRREAWGPEVAAAAMPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEGLSQFCPLHGKAGLTALPLYKACGLIVFGQLINLILLCNTFYVTFLFPLETLQILTVGMISSGVDWTAWGGGRSGGSEQSPACSRQLLLLPHAYVPQMQVS

SEQ ID NO: 804152 - protein, 708 aa, Homo sapiens; identical to SEQ ID NO: 804146

SEQ ID NO: 804153 - protein, 419 aa, Homo sapiens
GAAAGAARGGAAPAARSGPARPGAAAAAAAAAAATPEPVGAVREAAAEARPQRREAWGPEVAAAAMPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKS

SEQ ID NO: 804154 - protein, 439 aa, Homo sapiens; identical to SEQ ID NO: 804148

SEQ ID NO: 804155 - protein, 353 aa, Homo sapiens
GAAAGAARGGAAPAARSGPARPGAAAAAAAAAAATPEPVGAVREAAAEARPQRREAWGPEVAAAAMPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLVSFLQKEL

SEQ ID NO: 804156 - protein, 548 aa, Homo sapiens
MLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 804157 - protein, 740 aa, Homo sapiens
GAAAGAARGGAAPAARSGPARPGAAAAAAAAAAATPEPVGAVREAAAEARPQRREAWGPEVAAAAMPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGDDSSMRVTAPEDVPVGQEVEVVDSDTDAPDLWSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 804158 - protein, 708 aa, Homo sapiens; identical to SEQ ID NO: 804146

SEQ ID NO: 804159 - protein, 708 aa, Homo sapiens; identical to SEQ ID NO: 804146

SEQ ID NO: 804160 - protein, 143 aa, Homo sapiens
RARYPAHAEAPTQWEECGGGAQCEPAPTSWGNICYQTAVVVVEACRLCQRPDPRAHAPLSQQGILEKELLVRYLEQRRGKSRAIGCDEVTPFCPTTSGTDFPSLQSKAGLISVNSGAPASHECAPWVPSPLSISLSRLDLGSG

SEQ ID NO: 804161 - protein, 570 aa, Homo sapiens
GAAAGAARGGAAPAARSGPARPGAAAAAAAAAAATPEPVGAVREAAAEARPQRREAWGPEVAAAAMPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGDDSSMRVTAPEDVPVGQEVEVVDSDTDAPDLWSRIASWLPSFSVEVMHTTNILGITQASNSQLNAMVRSASCFKKITGN

SEQ ID NO: 804162 - protein, 152 aa, Homo sapiens
LLHCPDWSQTPGFSCPASASQSAGITGMSHHTRTLGVVLSPQQGAPAGPGGGLGTPYHSHPCKPRDRSRGCCFNATTRREAEGLCRARVLREGVTSTLAVLQADSSLGVSSTRRTAAGGAARAAAHGQSCPRATPATTPSPGSPRQGRLSME

SEQ ID NO: 804163 - protein, 809 aa, Homo sapiens
CSSITPPPFPKDNLQESSGGGELRLKEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804164 - protein, 534 aa, Homo sapiens
MTTGRNTFVADSARQGPVVLVSTSSLWLRVQLTRMENQSPQKTSRIWWLSVWDMTPGLLSWGMCRGGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804165 - protein, 653 aa, Homo sapiens
CSSITPPPFPKDNLQESSGGGELRLKEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804166 - protein, 749 aa, Homo sapiens
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804167 - protein, 727 aa, Homo sapiens
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKADDDWEEHLCRRLSETRTRGSRLNIIIVAEGAIDKNGKPITSEDIKNGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804168 - protein, 465 aa, Homo sapiens [sequence omitted]

SEQ ID NO: 804169 - protein, 523 aa, Homo sapiens
AHQPQPAAQLHRTTNFFIDNILRPDFGCKKEQPPRSFWWLRRPEKAQEEEADRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804170 - protein, 798 aa, Homo sapiens
QERDGSRELPGGDEPEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804171 - protein, 814 aa, Homo sapiens
WLGTRPGVNRPRPFPKDNLQESSGGGELRLKEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804172 - protein, 778 aa, Homo sapiens
CSSITPPPFPKDNLQESSGGGELRLKEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804173 - protein, 893 aa, Homo sapiens
CSSITPPPFPKDNLQESSGGGELRLKEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNVRMNEAREALESIAHSLLASESPDIASPLGPSAHLSLVSLPLIASHKEPLQDKRLSCPWFTQVSACFLPLTLVTLSLSLCWSLQLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804174 - protein, 767 aa, Homo sapiens
CSSITPPPFPKDNLQESSGGGELRLKEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804175 - protein, 820 aa, Homo sapiens
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804176 - protein, 858 aa, Homo sapiens
RCGEAREAKGAFKTSRNFSVPFSVWAFSLSRTRNTEAAMHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804177 - protein, 687 aa, Homo sapiens
CSSITPPPFPKDNLQESSGGGELRLKEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 804178 - protein, 214 aa, Homo sapiens
RCGEAREAKGAFKTSRNFSVPFSVWAFSLSRTRNTEAAMHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQLVCSRELPVPYLLCPCFIPLCFGLMVS

SEQ ID NO: 804179 - protein, 642 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKVEEKTYRGSSKRYSGFP

SEQ ID NO: 804180 - protein, 157 aa, Homo sapiens
TQLHPLTAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLR

SEQ ID NO: 804181 - protein, 99 aa, Homo sapiens
PVPGKVRGIHPGTAGLKPIRAVQTLWGKNNTMYTAKLPCLWLGATSILGVGSEGEKKERGRERERRAGKIPKGGRGGEKSTALLDLSFSAPWRSLGFLS

SEQ ID NO: 804182 - protein, 642 aa, Homo sapiens; identical to SEQ ID NO: 804179

SEQ ID NO: 804183 - protein, 329 aa, Homo sapiens
MLPTILGHMLPVALGPRRAKWRKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 804184 - protein, 588 aa, Homo sapiens
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKVEEKTYRGSSKRYSGFP

SEQ ID NO: 804185 - protein, 588 aa, Homo sapiens; identical to SEQ ID NO: 804184

SEQ ID NO: 804186 - protein, 642 aa, Homo sapiens; identical to SEQ ID NO: 804179

SEQ ID NO: 804187 - protein, 541 aa, Homo sapiens
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKVEEKTYRGSSKRYSGFP

SEQ ID NO: 804188 - protein, 588 aa, Homo sapiens; identical to SEQ ID NO: 804184

SEQ ID NO: 804189 - protein, 358 aa, Homo sapiens
MLPTILGHMLPVALGPRRAKWRKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 804190 - protein, 588 aa, Homo sapiens; identical to SEQ ID NO: 804184

SEQ ID NO: 804191 - protein, 588 aa, Homo sapiens; identical to SEQ ID NO: 804184

SEQ ID NO: 804192 - protein, 541 aa, Homo sapiens; identical to SEQ ID NO: 804187

SEQ ID NO: 804193 - protein, 541 aa, Homo sapiens; identical to SEQ ID NO: 804187

SEQ ID NO: 804194 - protein, 329 aa, Homo sapiens; identical to SEQ ID NO: 804183

SEQ ID NO: 804195 - protein, 337 aa, Homo sapiens
MLPTILGHMLPVALGPRRAKWRKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 804196 - protein, 642 aa, Homo sapiens; identical to SEQ ID NO: 804179

SEQ ID NO: 804197 - protein, 642 aa, Homo sapiens; identical to SEQ ID NO: 804179

SEQ ID NO: 804198 - protein, 642 aa, Homo sapiens; identical to SEQ ID NO: 804179

SEQ ID NO: 804199 - protein, 588 aa, Homo sapiens; identical to SEQ ID NO: 804184

SEQ ID NO: 804200 - protein, 325 aa, Homo sapiens
QERCRAVPFYFIPGGVRCRLLVLGLQLQYSGFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 804201 - protein, 642 aa, Homo sapiens; identical to SEQ ID NO: 804179

SEQ ID NO: 804202 - protein, 642 aa, Homo sapiens; identical to SEQ ID NO: 804179

SEQ ID NO: 804203 - protein, 126 aa, Homo sapiens
MIQSSSYPAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 804204 - protein, 642 aa, Homo sapiens; identical to SEQ ID NO: 804179

SEQ ID NO: 804205 - protein, 642 aa, Homo sapiens; identical to SEQ ID NO: 804179

SEQ ID NO: 804206 - protein, 642 aa, Homo sapiens; identical to SEQ ID NO: 804179

SEQ ID NO: 804207 - protein, 535 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLR

SEQ ID NO: 804208 - protein, 635 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKVESWFLFLSL

SEQ ID NO: 804209 - protein, 99 aa, Homo sapiens; identical to SEQ ID NO: 804181

SEQ ID NO: 804210 - protein, 84 aa, Homo sapiens
SLTFFRHIVLNAQEPSDELSLPGTLWNLSSHDSIKMEIVDHALHALTDEVIIPHSGWEREPNEDCKPRHIEWESVLTNTAGCLR

SEQ ID NO: 804211 - protein, 588 aa, Homo sapiens; identical to SEQ ID NO: 804184

SEQ ID NO: 804212 - protein, 642 aa, Homo sapiens; identical to SEQ ID NO: 804179

SEQ ID NO: 804213 - protein, 642 aa, Homo sapiens; identical to SEQ ID NO: 804179

SEQ ID NO: 804214 - protein, 541 aa, Homo sapiens; identical to SEQ ID NO: 804187

SEQ ID NO: 804215 - protein, 541 aa, Homo sapiens; identical to SEQ ID NO: 804187

SEQ ID NO: 804216 - protein, 541 aa, Homo sapiens; identical to SEQ ID NO: 804187

SEQ ID NO: 804217 - protein, 642 aa, Homo sapiens; identical to SEQ ID NO: 804179

SEQ ID NO: 804218 - protein, 642 aa, Homo sapiens; identical to SEQ ID NO: 804179

SEQ ID NO: 804219 - protein, 642 aa, Homo sapiens; identical to SEQ ID NO: 804179

SEQ ID NO: 804220 - protein, 642 aa, Homo sapiens; identical to SEQ ID NO: 804179

SEQ ID NO: 804221 - protein, 329 aa, Homo sapiens; identical to SEQ ID NO: 804183

SEQ ID NO: 804222 - protein, 642 aa, Homo sapiens; identical to SEQ ID NO: 804179

SEQ ID NO: 804223 - protein, 642 aa, Homo sapiens; identical to SEQ ID NO: 804179

SEQ ID NO: 804224 - protein, 642 aa, Homo sapiens; identical to SEQ ID NO: 804179

SEQ ID NO: 804225 - protein, 642 aa, Homo sapiens; identical to SEQ ID NO: 804179

SEQ ID NO: 804226 - protein, 356 aa, Homo sapiens
MDTQGPVSQPFQQPEKPGRVRRRKTRRERNKALVGSRRPLAHHDPPVAIRDPPVVPTASKLVVITQGRLSREHRGLFNHEVKSLDVARLLSSGTLVPGSPTLPAKPSPSPGRAQEPAPRSRDKENQVPGGSGPGPPSSPELSGVGQLLAELQCQLSLPQAFPRRNLIQDARDAIVHTLQACHGCVPDLALVLRGCQPPLPGAKPGVSERKMTPFWINSPDQVPEQERQRKQQGTKEFTFPMPYTSSMPTAHRGSLAPPRGPWPPYFPSLSSPSGTAWGPPTAFDLLKSIWLVATPPPPRPWGVGLPQPLPQPSSPLLPRTSVLDWSPSPPSPLPSLSWVVAQSSPEAWSFPPMRLY

SEQ ID NO: 804227 - protein, 388 aa, Homo sapiens
FESWGHRGKEAIAPHSYVKWEGPGFVGAREDTMDTQGPVSQPFQQPEKPGRVRRRKTRRERNKALVGSRRPLAHHDPPVAIRDPPVVPTASKLVVITQGRLSREHRGLFNHEVKSLDVARLLSSGTLVPGSPTLPAKPSPSPGRAQEPAPRSRDKENQVPGGSGPGPPSSPELSGVGQLLAELQCQLSLPQAFPRRNLIQDARDAIVHTLQACHGCVPDLALVLRGCQPPLPGAKPGVSERKMTPFWINSPDQVPEQERQRKQQGTKEFTFPMPYTSSMPTAHRGSLAPPRGPWPPYFPSLSSPSGTAWGPPTAFDLLKSIWLVATPPPPRPWGVGLPQPLPQPSSPLLPRTSVLDWSPSPPSPLPSLSWVVAQSSPEAWSFPPMRLY

SEQ ID NO: 804228 - protein, 216 aa, Homo sapiens
MPGMPSCTPCRPVMVVCLTLPWCFGAASHPCQVSVPPAPVLPFPLSALAQLASMLLSSVPGAKPGVSERKMTPFWINSPDQVPEQERQRKQQGTKEFTFPMPYTSSMPTAHRGSLAPPRGPWPPYFPSLSSPSGTAWGPPTAFDLLKSIWLVATPPPPRPWGVGLPQPLPQPSSPLLPRTSVLDWSPSPPSPLPSLSWVVAQSSPEAWSFPPMRLY

SEQ ID NO: 804229 - protein, 351 aa, Homo sapiens
MAPVLPLVLPLQPRIRLAQGLWLLSWLLALAGGVILLCSGHLLVQLRHLGTFLAPSCQFPVLPQAALAAGAVALGTGLVGVGASRASLNAALYPPWRGVLGPLLVAGTAGGGGLLVVALGLALALPGSLDEALEEGLVTALAHYKDTEVPGHCQAKRLVDELQLRYHCCGRHGYKDWFGVQWVSSRYLDPGDRDVADRIQSNVEGLYLTDGVPFSCCNPHSPRPCLQNRLSDSYAHPLFDPRQPNQNLWAQGCHEVLLEHLQDLAGTLGSMLAVTFLLQALVLLGLRYLQTALEGLGGVIDAGGETQGYLFPSGLKDMLKTAWLQGGVACRPAPEEAPPGEAPPKEDLSEA

SEQ ID NO: 804230 - protein, 166 aa, Homo sapiens
DSCSDSLISTAHRIQSNVEGLYLTDGVPFSCCNPHSPRPCLQNRLSDSYAHPLFDPRQPNQNLWAQGCHEVLLEHLQDLAGTLGSMLAVTFLLQALVLLGLRYLQTALEGLGGVIDAGGETQGYLFPSGLKDMLKTAWLQGGVACRPAPEEAPPGEAPPKEDLSEA

SEQ ID NO: 804231 - protein, 319 aa, Homo sapiens
MAPVLPLVLPLQPRIRLAQGLWLLSWLLALAGGVILLCSGHLLVQLRHLGTFLAPSCQFPVLPQAALAAGAVALGTGLVGVGASRASLNAALYPPWRGVLGPLLVAGTAGGGGLLVVALGLALALPGSLDEALEEGLVTALAHYKDTEVPGHCQAKRLVDELQLSRIQSNVEGLYLTDGVPFSCCNPHSPRPCLQNRLSDSYAHPLFDPRQPNQNLWAQGCHEVLLEHLQDLAGTLGSMLAVTFLLQALVLLGLRYLQTALEGLGGVIDAGGETQGYLFPSGLKDMLKTAWLQGGVACRPAPEEAPPGEAPPKEDLSEA

SEQ ID NO: 804232 - protein, 220 aa, Homo sapiens [sequence omitted]

SEQ ID NO: 804233 - protein, 111 aa, Homo sapiens
GRSQSLPARAEAPKSKRERLGLSSCPRVLLCCLGWSAVVQARLTAALTSWDQGLAGGLLNLFIFSKTRSLAGCGCPHLSSQHFGRLRQEDRLNPRVGDQPGQHREILSLKK

SEQ ID NO: 804234 - protein, 40 aa, Homo sapiens
MSATNPPFRESLRRRDGSTGTGCTADSAQKNAHLSCNRAD

SEQ ID NO: 804235 - protein, 85 aa, Homo sapiens
LATRMAFVTRASPIRPILGPYTASFSHAHRKGSVDGALSMTSLGKIKCSSFLRAGGCSWAAPSSQKQYLSWRKSVVLQDIVNLGF

SEQ ID NO: 804236 - protein, 117 aa, Homo sapiens
MFASISPSHLTPSSASQNIPWYLRPFQFPPGFVGGRIKKKLHCSHPHSYSHFIKQKSSLEPLQNKIPATTPLFSFRLQLFILAKKLQSAPPRRKEYPVLMGVHRRLQAAPLQRLTSR

SEQ ID NO: 804237 - protein, 167 aa, Homo sapiens
MGRMWLVLGESYSLCWSQTALHCRKLLFQWPWLGPSTPSLCPRPLSPFRAIRDSRRAVDNRISSELGNSRFKISVENERHSRLTRASGLPRTSSPSPTGWNSVAIAPYSDGSLCQISSIFGDSSSKTAGEENGLKDSSVGCRIDSETYTSSLSPEKSSSCGSLSLAA

SEQ ID NO: 804238 - protein, 390 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 804239 - protein, 390 aa, Homo sapiens; identical to SEQ ID NO: 804238

SEQ ID NO: 804240 - protein, 299 aa, Homo sapiens
MWYRGIHHQLHQGRIQGPSYSEAIPTQESVPSGEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 804241 - protein, 135 aa, Homo sapiens
QPFVWGGWHGPLMPFSSLFPWLCGEALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 804242 - protein, 129 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSGRFLR

SEQ ID NO: 804243 - protein, 1106 aa, Homo sapiens
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 804244 - protein, 858 aa, Homo sapiens
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHHGCGQHECLTEIPTWGNRIPQL

SEQ ID NO: 804245 - protein, 1106 aa, Homo sapiens; identical to SEQ ID NO: 804243

SEQ ID NO: 804246 - protein, 154 aa, Homo sapiens
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTMRCSQPRAKRPLKPLPKSIKSLKPSN

SEQ ID NO: 804247 - protein, 46 aa, Homo sapiens
MERSAFMEQDAGSGLVMRLHERPALLVSSTPGQSWMPPPRHGLNEK

SEQ ID NO: 804248 - protein, 215 aa, Homo sapiens
NSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 804249 - protein, 127 aa, Homo sapiens
MSQKKEEKKTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 804250 - protein, 113 aa, Homo sapiens
LALLTTGAFALFGVFALASISSVPLCPLRLGSSALTTQYGAAFWVTLATGVLCLFLGGAVVSLQYVRPSALRTLLDQSAKDCSQERGGSPLILGDPLHKQAALPDLKCITTNL

SEQ ID NO: 804251 - protein, 298 aa, Homo sapiens
EAVLRLMAVPTELDGGSVKETAAEEESRVLAPGAAPFGNFPHYSRFHPPEQRLRLLPPELLRQLFPESPENGPILGLDVGCNSGDLSVALYKHFLSLPDGETCSDASREFRLLCCDIDPVLVKRAEKECPFPDALTFITLDFMNQRTRKVLLSSFLSQFGRSVFDIGFCMSITMWIHLNHGDHGLWEFLAHLSSLCHYLLVEPQPWKCYRAAARRLRKLGLHDFDHFHSLAIRGDMPNQIVQILTQDHGMELICCFGNTSWDRSLLLFRAKQTIETHPIPESLIEKGKEKNRLSFQKQ

SEQ ID NO: 804252 - protein, 298 aa, Homo sapiens; identical to SEQ ID NO: 804251

SEQ ID NO: 804253 - protein, 221 aa, Homo sapiens
PPPPRLSRFLSPDAIGPTGEPGSMGQKKPPSFFFILLAQHDPVLVKRAEKECPFPDALTFITLDFMNQRTRKVLLSSFLSQFGRSVFDIGFCMSITMWIHLNHGDHGLWEFLAHLSSLCHYLLVEPQPWKCYRAAARRLRKLGLHDFDHFHSLAIRGDMPNQIVQILTQDHGMELICCFGNTSWDRSLLLFRAKQTIETHPIPESLIEKGKEKNRLSFQKQ

SEQ ID NO: 804254 - protein, 97 aa, Homo sapiens
ACPGDLARPGLCQPSLLGTTEVARARLRKAAGLEALGSESELAPLAPGGERVGERPRSSSVENAPLPAFCKAYLGAERQASCHVISSPLRGPCDVKE

SEQ ID NO: 804255 - protein, 186 aa, Homo sapiens
AAREYAWTLWNAGPPRAPPLSGSCRETRPVGKPAEPQPRPRKVSLGPGPDSHPCAGPRASQALHCRPGCAQGRQPPAALFVPPLQEGRGRGGALQAVSHARGGARASGRRTGEHAGEDTWAFARILRKQSNSYNKMGRRNENCANSLRVSNISQENLSHWNLDSEVPVSENKNLPAGRDGAAGGKN

SEQ ID NO: 804256 - protein, 206 aa, Homo sapiens
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQLVEMLDMSVPAVAKLRRLLDSLPREALPDILTSIIRTSNKEKLQVQCSLL

SEQ ID NO: 804257 - protein, 213 aa, Homo sapiens
MPSRKQTGVFGVKIAVVTKRERSKVPYIMRQCVEEIERRGMEEITEDVSVMMSEMDVNAIAGTLKLYFRELPEPLFTDEFYPNFAEGIVVAEKEAVNKMSLHNLATVFGPTLLRPSEKESKLPANPSQPVTMTDSRSLEVMSQGPRAGGCFGSTATSYPPPASTACVVAKPVWGWGTQRSPGGDPALLLQCRRRPRCQCDLPQGVASRLPGRK

SEQ ID NO: 804258 - protein, 82 aa, Homo sapiens
MRQCVEEIERRGMEEVGIYRVSGVATDIQALKAGFNVSECRPAQDGMEVWAVVSAMRSQSAPWPRHVTSFSVSFLHLLFYYF

SEQ ID NO: 804259 - protein, 412 aa, Homo sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 804260 - protein, 444 aa, Homo sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLECSGAISAHYTSASQAQALLLPQTPDNWDYRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 804261 - protein, 153 aa, Homo sapiens
QAGLRVTGWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 804262 - protein, 108 aa, Homo sapiens [sequence omitted]

SEQ ID NO: 804263 - protein, 68 aa, Homo sapiens
VCSPGLPFPAFRLQRPPAPARCPKQNGRHVQCLSDRLKWRLRNYVRRQIRARLEGGKDLSYACAEYPA

SEQ ID NO: 804264 - protein, 123 aa, Homo sapiens
MHLDLFLNKTLPQIRGVESEQSSRLHPLPDPRGDRHRMADNLPMEIHGSSATSSGKPSDFNQAAVDGAGERGGKEVLGGTLDVLPQAGPCSTCGWLCWLSPNRPRKFDTSGLGSSSLLLPRCL

SEQ ID NO: 804265 - protein, 119 aa, Homo sapiens
MADPGGRLEIIFSSWAPRSLPQSQLRQEFRKELWMIEQQRVQECVTGWTEKRMPLPAPPAAPQGVVSACTKPVLEQGVRDAPFQDPCHRETGAGRICGVLGSALCPAAAEERSALTKVS

SEQ ID NO: 804266 - protein, 112 aa, Homo sapiens
MADPGGRLEIIFSSWAPRSLPQSQLRQEFRKELWMIEQQRVQECVTGWTEKRMPLPAPPAAPQGVVSACTKPVLEQGVRDAPFQDPCHRETGAGRICGVLGSALCPAAAEER

SEQ ID NO: 804267 - protein, 123 aa, Homo sapiens; identical to SEQ ID NO: 804264

SEQ ID NO: 804268 - protein, 34 aa, Homo sapiens
MGWAGPEDSYVGDEAQSKRGILTLKYPIEHGIVT

SEQ ID NO: 804269 - protein, 119 aa, Homo sapiens; identical to SEQ ID NO: 804265

SEQ ID NO: 804270 - protein, 112 aa, Homo sapiens; identical to SEQ ID NO: 804266

SEQ ID NO: 804271 - protein, 75 aa, Homo sapiens
MVVAQQAAPNDGQSITSNDGDRRSLTTDRAASTQPAPHASTNTTPSVGDTQRNSPPHNQAARATNTACCRHHTAR

SEQ ID NO: 804272 - protein, 80 aa, Homo sapiens
MAAEPLTELEESIETVVTTFFTFARQEGRKDSLSVNEFKELVTQQLPHLLKDVGSLDEKMKSLDVNQVQMQEFNELKHLD

SEQ ID NO: 804273 - protein, 132 aa, Homo sapiens
MAAEPLTELEESIETVVTTFFTFARQEGRKDSLSVNEFKELVTQQLPHLLKDVGSLDEKMKSLDVNQDSQLKHNLRTVDSIVELMHHLLILIHLSFISLPELSSKNKYNYTTTPYPYTLIYACNTLSTITPP

SEQ ID NO: 804274 - protein, 258 aa, Homo sapiens
RTQVGQVPVTPAPSAPGVVQTCPGVLLTSRAGRSWRRITSPLPASCSMKADRSMAGSSGSELKGRKKPCERPQSRPRTQNGHLLPWQGLQAPNGWGAQPHQQHQATPANRGMGLLSLILFLGAKVTTANKTDSFLFSTGLTVLSSPGLKMRVLGCPPTPPQLTQGHTSGYVDLHKGPFLSPMRHPRGHTGPQILPQAWEPIGRRVRQCRGPQTFLKGPESKYFRLCRPDVLCCKTQFCYCSSKAAIDNSEVNECVVSQ

SEQ ID NO: 804275 - protein, 129 aa, Homo sapiens
MAPPRPANHSRGPIQKWLSVHEDHLQHPCDCTPNQPAARTYCLVTSPLFPQLSLKKSGFQIFRETDLGPAPGRKAACISSVREQMRQQDSKSRKRASRKTSTSEDGERGHLGTTLQLRQTRTLPVYRRL

SEQ ID NO: 804276 - protein, 258 aa, Homo sapiens; identical to SEQ ID NO: 804274

SEQ ID NO: 804277 - protein, 441 aa, Homo sapiens
CGRGLQERGEALAAYLDGREPVLRFRPREEEALLGEIVRAAAAGSGDLPPLGPATLLALCVQHSARELELGHLPRLLGRLARLIKEAVWEKIKEIGDRQPENHPEGVPEVPLTPEAVSVELRPLMLWMANTTELLSFVQEKVLEMEKEADQEDPQLCNDLELCDEAMALLDEVIMCTFQQSVYYLTKTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTGDIFESFSSHPPLILPLGSSRLRLTGPVTDDALHRELRRLRRLLWDLEQQELPANYRHGPPVATSP

SEQ ID NO: 804278 - protein, 715 aa, Homo sapiens
AGPTLPRSPPPGLVSSQDAPSPLFLPGFLLPFPVPHPVLGAVAEARAVELTQASGARASGCAGPEAGAMLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTGDIFESFSSHPPLILPLGSSRLRLTGPVTDDALHRELRRLRRLLWDLEQQELPANYRHGPPVATSP

SEQ ID NO: 804279 - protein, 725 aa, Homo sapiens
AGPTLPRSPPPGLVSSQDAPSPLFLPGFLLPFPVPHPVLGAVAEARAVELTQASGARASGCAGPEAGAMLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTDSNRAAFGLTGDIFESFSSHPPLILPLGSSRLRLTGPVTDDALHRELRRLRRLLWDLEQQELPANYRHGPPVATSP

SEQ ID NO: 804280 - protein, 627 aa, Homo sapiens
AGPTLPRSPPPGLVSSQDAPSPLFLPGFLLPFPVPHPVLGAVAEARAVELTQASGARASGCAGPEAGAMLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKGTSSKASPRTRPSSSPWGARACASLVQ

SEQ ID NO: 804281 - protein, 715 aa, Homo sapiens; identical to SEQ ID NO: 804278

SEQ ID NO: 804282 - protein, 269 aa, Homo sapiens
GVVVQSLVSTSLFSQTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTGDIFESFSSHPPLILPLGSSRLRLTGPVTDDALHRELRRLRRLLWDLEQQELPANYRHGPPVATSP

SEQ ID NO: 804283 - protein, 612 aa, Homo sapiens
AGPTLPRSPPPGLVSSQDAPSPLFLPGFLLPFPVPHPVLGAVAEARAVELTQASGARASGCAGPEAGAMLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKVTPGQLYLTPDL

SEQ ID NO: 804284 - protein, 465 aa, Homo sapiens
LAGESEAPPTRLGKLGVALAGGGAGGGFLAEGGADVGYRVCQPNPEQRRWRWWPSPVAPVLLALELVAMEELQEPLRGQLRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLLQYRAIHSAEQQHAYEQDFETDYAEYRILHARVGTASQRFIELGAEIKRVRRGTPEYKVLEDKIIQEYKKFRKQYPSYREEKRRCEYLHQKLSHIKGLILEFEEKNRGS

SEQ ID NO: 804285 - protein, 484 aa, Homo sapiens
TLKGLQVQLSLRDSNSKFRVAGETKAGLGTLSERSDAGRGLFLPRTGDSSSDSPKRFMRILEESAERRWRWWPSPVAPVLLALELVAMEELQEPLRGQLRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLLQYRAIHSAEQQHAYEQDFETDYAEYRILHARVGTASQRFIELGAEIKRVRRGTPEYKVLEDKIIQEYKKFRKQYPSYREEKRRCEYLHQKLSHIKGLILEFEEKNRGS

SEQ ID NO: 804286 - protein, 540 aa, Homo sapiens
LAGESEAPPTRLGKLGVALAGGGAGGGFLAEGGADVGYRVCQPNPEQRRWRWWPSPVAPVLLALELVAMEELQEPLRGQLRLCFTQAARTSLLLLRLNDAALRALQECQRQQVRPAPFFSSHCPQGPWASAGDPGEGAGERERLPQALASPPLQVKPARQVIPGSGRRILGTLLHLRSTVTSSLSPQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLLQYRAIHSAEQQHAYEQDFETDYAEYRILHARVGTASQRFIELGAEIKRVRRGTPEYKVLEDKIIQEYKKFRKQYPSYREEKRRCEYLHQKLSHIKGLILEFEEKNRGS

SEQ ID NO: 804287 - protein, 376 aa, Homo sapiens
TLKGLQVQLSLRDSNSKFRVAGETKAGLGTLSERSDAGRGLFLPRTGDSSSDSPKRFMRILEESAERRWRWWPSPVAPVLLALELVAMEELQEPLRGQLRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLL

SEQ ID NO: 804288 - protein, 401 aa, Homo sapiens
QGKKEERRRGGSGNNGGGARPGWSRTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLLQYRAIHSAEQQHAYEQDFETDYAEYRILHARVGTASQRFIELGAEIKRVRRGTPEYKVLEDKIIQEYKKFRKQYPSYREEKRRCEYLHQKLSHIKGLILEFEEKNRGS

SEQ ID NO: 804289 - protein, 282 aa, Homo sapiens [sequence omitted]

SEQ ID NO: 804290 - protein, 140 aa, Homo sapiens
MPLESSSSMPLSFPSLLPSVPHNTNPSPPLMSYITSQEMKCILHWFANWSGPQRERFLEDLVAKAVPEKLQPLLDSLEQLSVSGADRPPSIFECQLHLWDQWFRGWAEQERNEFVRQLEFSEPDFVAKFYQAVAATAGKD

SEQ ID NO: 804291 - protein, 140 aa, Homo sapiens; identical to SEQ ID NO: 804290

SEQ ID NO: 804292 - protein, 140 aa, Homo sapiens; identical to SEQ ID NO: 804290

SEQ ID NO: 804293 - protein, 125 aa, Homo sapiens
MPLESSSSMPLSFPSLLPSVPHNTNPSPPLMSYITSQEMKCILHWFANWSGPQRERFLEDLVAKAVPEKLQPLLDSLEQLSVSGADRPPSIFECQLHLWDQWFRGWAEQERNEMLEGAIRCWKGS

SEQ ID NO: 804294 - protein, 140 aa, Homo sapiens; identical to SEQ ID NO: 804290

SEQ ID NO: 804295 - protein, 125 aa, Homo sapiens
MPLESSSSMPLSFPSLLPSVPHNTNPSPPLMSYITSQEMKCILHWFANWSGPQRERFLEDLVAKAVPEKLHRPPSIFECQLHLWDQWFRGWAEQERNEFVRQLEFSEPDFVAKFYQAVAATAGKD

SEQ ID NO: 804296 - protein, 152 aa, Homo sapiens
MDWPLRVNPLSVARLSHVVIVHHIPMQVTTRMTNTCALLTSGWCFTVSQEMKCILHWFANWSGPQRERFLEDLVAKAVPEKLQPLLDSLEQLSVSGADRPPSIFECQLHLWDQWFRGWAEQERNEFVRQLEFSEPDFVAKFYQAVAATAGKD

SEQ ID NO: 804297 - protein, 102 aa, Homo sapiens [sequence omitted]

SEQ ID NO: 804298 - protein, 104 aa, Homo sapiens
SPGMGVPSVVSTGVRSKTLEWLSGGVVYAVESNSQPLLDSLEQLSVSGADRPPSIFECQLHLWDQWFRGWAEQERNEFVRQLEFSEPDFVAKFYQAVAATAGKD

SEQ ID NO: 804299 - protein, 140 aa, Homo sapiens; identical to SEQ ID NO: 804290

SEQ ID NO: 804300 - protein, 727 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSDSTVPCPYSSKADVVDSETVVRARGLPWQSSDQDVARFFKGLNVARGGVALCLNAQGRRNGEALIRFVDSEQRDLALQRHKHHMGVRYIEVYKATGEEFVKIAGGTSLEVARFLSREDQVILRLRGLPFSAGPTDVLGFLGPECPVTGGTEGLLFVRHPDGRPTGDAFALFACEELAQAALRRHKGMLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKVMKERYVEVVPCSTEEMSRVLMGGTLGRSGMSPPPCKLPCLSPPTYTTFQATPTLIPTETAALYPSSALLPAARVPAAPTPVAYYPGPATQLYLNYTAYYPSPPVSPTTVGYLTTPTAALASAPTSVLSQSGALVRMQGVPYTAGMKDLLSVFQAYQLPADDYTSLMPVGDPPRTVLQAPKEWVCL

SEQ ID NO: 804301 - protein, 171 aa, Homo sapiens
MLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKASHHLPTPPSKPPQRSFPRRRQLYTPLQHCSQLPGCLLPPPLLPTIQGQPLNST

SEQ ID NO: 804302 - protein, 717 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSKADVVDSETVVRARGLPWQSSDQDVARFFKGLNVARGGVALCLNAQGRRNGEALIRFVDSEQRDLALQRHKHHMGVRYIEVYKATGEEFVKIAGGTSLEVARFLSREDQVILRLRGLPFSAGPTDVLGFLGPECPVTGGTEGLLFVRHPDGRPTGDAFALFACEELAQAALRRHKGMLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKVMKERYVEVVPCSTEEMSRVLMGGTLGRSGMSPPPCKLPCLSPPTYTTFQATPTLIPTETAALYPSSALLPAARVPAAPTPVAYYPGPATQLYLNYTAYYPSPPVSPTTVGYLTTPTAALASAPTSVLSQSGALVRMQGVPYTAGMKDLLSVFQAYQLPADDYTSLMPVGDPPRTVLQAPKEWVCL

SEQ ID NO: 804303 - protein, 717 aa, Homo sapiens; identical to SEQ ID NO: 804302

SEQ ID NO: 804304 - protein, 303 aa, Homo sapiens
MLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKVMKERYVEVVPCSTEEMSRVLMGGTLGRSGMSPPPCKLPCLSPPTYTTFQATPTLIPTETAALYPSSALLPAARVPAAPTPVAYYPGPATQLYLNYTAYYPSPPVSPTTVGYLTTPTAALASAPTSVLSQSGALVRMQGVPYTAGMKDLLSVFQAYQLPADDYTSLMPVGDPPRTVLQAPKEWVCL

SEQ ID NO: 804305 - protein, 282 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHSTLPELHSLLPKPPSLPHHCGLPHYTHCCPGLCSHLSVVPVRSLGPHAGCPIHGWYEGSAQRLPGLPATR

SEQ ID NO: 804306 - protein, 643 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSKADVVDSETVVRARGLPWQSSDQDVARFFKGLNVARGGVALCLNAQGRRNGEALIRFVDSEQRDLALQRHKHHMGVRYIEVYKATGEEFVKIAGGTSLEVARFLSREDQVILRLRGLPFSAGPTDVLGFLGPECPVTGGTEGLLFVRHPDGRPTGDAFALFACEELAQAALRRHKGMLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKVMKERYVEVVPCSTEEMSRVLMGGTLGRSGMSPPPCKLPCLSPPTYTTFQATPTLIPTETAALYPSSALLPAARVPAAPTPVAYYPGPATQLYLNYTAYYPSPVPHMWVLIN

SEQ ID NO: 804307 - protein, 462 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSKADVVDSETVVRARGLPWQSSDQDVARFFKGLNVARGGVALCLNAQGRRNGEALIRFVDSEQRDLALQRHKHHMGVRYIEVYKATGEEFVKIAGGTSLEVARFLSREDQVILRLRGLPFSAGPTDVLGFLGPECPVTGGTEGLLFVRHPDGRPTGDAFALFACEELAQAALRRHKGMLGKRYIELFRSTAAEVQQVSAQGSPPPDVLLLQGGPLCPCPTWHDQP

SEQ ID NO: 804308 - protein, 347 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSDSTVPCPYSSKADVVDSETVVRARGLPWQSSDQDVARFFKGLNVARGGVALCLNAQGRRNGEALIRFVDSEQRDLALQRHKHHMGVRYIESMSRLGWRMSSSTQAQQWR

SEQ ID NO: 804309 - protein, 121 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQVSAGVGGGMAWT

SEQ ID NO: 804310 - protein, 214 aa, Homo sapiens
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGICDPAGLGWRSHCGYMCLSMCMLWVGNM

SEQ ID NO: 804311 - protein, 150 aa, Homo sapiens
EEEAEETAAVPEEGVVITGYCRSPETSGAGAGPGAPRSSWDTLASRRRGRARAPQRQDRDYTQEGQGAGPDARSGFSPASGLDPASAAGRGSESRNHLPFLAFSRERSRESASSLTRAGKTDGTCRRRTPISIAAARASLSESVKALRGC

SEQ ID NO: 804312 - protein, 42 aa, Homo sapiens
MVSPDPQIIVVAPETELASMQVQRTEDGVTIIQIFGVGRKGE

SEQ ID NO: 804313 - protein, 276 aa, Homo sapiens
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLGWSTMA

SEQ ID NO: 804314 - protein, 123 aa, Homo sapiens
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPLKNC

SEQ ID NO: 804315 - protein, 753 aa, Homo sapiens
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLGENMMKGSELTPKQEFFKGSESSNRTSGGLFGVVPGAAETGDVCEDTFKELEGQTSDEEGSRLENDFLEITDEDKKKSTKDRYDKYKEVGEHPPLSSSPVEHEGVLKGQKSYRCDECGKAFNRSSHLIGHQRIHTGEKPYECNECGKTFRQTSQLIVHLRTHTGEKPYECSECGKAYRHSSHLIQHQRLHNGEKPYKCNECAKAFTQSSRLIDHQRTHTGEKPYECNECGEAFIRSKSLARHQVLHTGKKPYKCNECGRAFCSNRNLIDHQRIHTGEKPYECSECGKAFSRSKCLIRHQSLHTGEKPYKCSECGKAFNQNSQLIEHERIHTGEKPFECSECGKAFGLSKCLIRHQRLHTGEKPYKCNECGKSFNQNSHLIIHQRIHTGEKPYECNECGKVFSYSSSLMVHQRTHTGEKPYKCNDCGKAFSDSSQLIVHQRVHTGEKPYECSECGKAFSQRSTFNHHQRTHTGEKSSGLAWSVS

SEQ ID NO: 804316 - protein, 753 aa, Homo sapiens; identical to SEQ ID NO: 804315

SEQ ID NO: 804317 - protein, 479 aa, Homo sapiens
MKGSELTPKQEFFKGSESSNRTSGGLFGVVPGAAETGDVCEDTFKELEGQTSDEEGSRLENDFLEITDEDKKKSTKDRYDKYKEVGEHPPLSSSPVEHEGVLKGQKSYRCDECGKAFNRSSHLIGHQRIHTGEKPYECNECGKTFRQTSQLIVHLRTHTGEKPYECSECGKAYRHSSHLIQHQRLHNGEKPYKCNECAKAFTQSSRLIDHQRTHTGEKPYECNECGEAFIRSKSLARHQVLHTGKKPYKCNECGRAFCSNRNLIDHQRIHTGEKPYECSECGKAFSRSKCLIRHQSLHTGEKPYKCSECGKAFNQNSQLIEHERIHTGEKPFECSECGKAFGLSKCLIRHQRLHTGEKPYKCNECGKSFNQNSHLIIHQRIHTGEKPYECNECGKVFSYSSSLMVHQRTHTGEKPYKCNDCGKAFSDSSQLIVHQRVHTGEKPYECSECGKAFSQRSTFNHHQRTHTGEKSSGLAWSVS

SEQ ID NO: 804318 - protein, 144 aa, Homo sapiens [sequence omitted]

SEQ ID NO: 804319 - protein, 276 aa, Homo sapiens
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLGNDSVS

SEQ ID NO: 804320 - protein, 458 aa, Homo sapiens
RGTGGGRGQQRKLPAAGTGPAQAAYGGRRVGPRVTAGQLGPARSLRVGSPQHKMLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERNRKVIEKVVDIDFVLQARTIRQFDERYTSVAFGYQDCVTYYKAASPRTKIDAIRIPVLYLSAADDPFSPVCALPIQAAQHSPYVALLITARGGHIGFLEGLLPWQHWYMSRLLHQYAKAIFQDPEGLPDLRALLPSEDRNS

SEQ ID NO: 804321 - protein, 206 aa, Homo sapiens
RGTGGGRGQQRKLPAAGTGPAQAAYGGRRVGPRVTAGQLGPARSLRVGSPQHKMLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQ

SEQ ID NO: 804322 - protein, 218 aa, Homo sapiens
MAPGQTPSLCSWLLPLPSTWATTGHVCFSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERNRKVIEKVVDIDFVLQV

SEQ ID NO: 804323 - protein, 218 aa, Homo sapiens; identical to SEQ ID NO: 804322

SEQ ID NO: 804324 - protein, 102 aa, Homo sapiens
MAPGQTPSLCSWLLPLPSTWATTGHVCFSDILQTPDGGQLLLDWAKQPDSSQDPDPTTQPIVLLLPGITGSSQETYVLHLVNQALRDGYQPTGLFVPAILKI

SEQ ID NO: 804325 - protein, 161 aa, Homo sapiens
TCTGRLWRAAGGTASYSRPTGASQEPEGRKPPTQDAELLPEPPEWHLGRHLLSALGSCRCPLLGLLLGMCASGGCGSTALASGFGCRGQLPDTGLGPWWELGWLGFPTGEICYHRMESRLCLSSASASHVIPMPAGPFGYRRVLLPIMWTSIWGKVGWKAS

SEQ ID NO: 804326 - protein, 338 aa, Homo sapiens
EGGRKKHLPARLVTEMDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804327 - protein, 338 aa, Homo sapiens; identical to SEQ ID NO: 804326

SEQ ID NO: 804328 - protein, 270 aa, Homo sapiens
EGGRKKHLPARLVTEMDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALEGVWSLARASE

SEQ ID NO: 804329 - protein, 302 aa, Homo sapiens
EGGRKKHLPARLVTEMDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQFCWPP

SEQ ID NO: 804330 - protein, 270 aa, Homo sapiens
EGGRKKHLPARLVTEMDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSMGGPELPGALGGPSPLCLGKKAQANPSPDCPALPATAWGCGPGQELQ

SEQ ID NO: 804331 - protein, 306 aa, Homo sapiens
EGGRKKHLPARLVTEMDSKYQCVKLNDGHFMPVLGFGTYAPAEVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804332 - protein, 225 aa, Homo sapiens
EGGRKKHLPARLVTEMDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYIPPADEQDGKASDNPKVTLILKSPKK

SEQ ID NO: 804333 - protein, 169 aa, Homo sapiens
EGGRKKHLPARLVTEMDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEVSVWR

SEQ ID NO: 804334 - protein, 169 aa, Homo sapiens; identical to SEQ ID NO: 804333

SEQ ID NO: 804335 - protein, 175 aa, Homo sapiens
MAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804336 - protein, 198 aa, Homo sapiens
EGGRKKHLPARLVTEMDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEPWRSIKRGEYNLPVEYNPAVGYNLPLEYNLPGIL

SEQ ID NO: 804337 - protein, 149 aa, Homo sapiens [sequence omitted]

SEQ ID NO: 804338 - protein, 456 aa, Homo sapiens
SGGVRSRRAARRDGTCGPASWSVPGSPATGSRPRHRLRKMALSAQQIPRWFNSVKLRSLINAAQLTKRFTRPARTLLHGFSAQPQISSDNCFLQWGFKTYRTSSLWNSSQSTSSSSQENNSAQSSLLPSMNEQSQKTQNISSFDSELFLEELDELPPLSPMQPISEEEAIQIIADPPLPPASFTLRDYVDHSETLQKLVLLGVDLSKIEKHPEAANLLLRLDFEKDIKQMLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVYRLELGFKHNEIQHMITRIPKMLTANKMKLTETFDFVHNVMSIPHHIIVKFPQVFNTRLFKVKERHLFLTYLGRAQYDPAKPNYISLDKLVSIPDEIFCEEIAKASVQDFEKFLKTL

SEQ ID NO: 804339 - protein, 296 aa, Homo sapiens
MQPISEEEAIQIIADPPLPPASFTLRDYVDHSETLQKLVLLGVDLSKIEKHPEAANLLLRLDFEKDIKQMLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVYRLELGFKHNEIQHMITRIPKMLTANKMKLTETFDFVHNVMSIPHHIIVKFPQVFNTRLFKVKERHLFLTYLGRAQYDPAKPNYISLDKLVSIPDEIFCEEIAKASVQDFEKFLKTL

SEQ ID NO: 804340 - protein, 402 aa, Homo sapiens
SGGVRSRRAARRDGTCGPASWSVPGSPATGSRPRHRLRKMALSAQQIPRWFNSVKLRSLINAAQLTKRFTRPARTLLHGFSAQPQISSDNCFLQWGFKTYRTSSLWNSSQSTSSSSQENNSAQSSLLPSMNEQSQKTQNISSFDSELFLEELDELPPLSPMQPISEEEAIQIIADPPLPPASFTLRDYVDHSETLQKLVLLGVDLSKIEKHPEAANLLLRLDFEKDIKQMLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVFNTRLFKVKERHLFLTYLGRAQYDPAKPNYISLDKLVSIPDEIFCEEIAKASVQDFEKFLKTL

SEQ ID NO: 804341 - protein, 4367 aa, Homo sapiens
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNADLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYRYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESMDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDYTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMF

SEQ ID NO: 804342 - protein, 109 aa, Homo sapiens
SGRRLSQRLLGGCVRAPARRGGRALRVRPETWEEAGEKMPSESFCLAAQARLDSKWLKTDIQVLSVGRYESPVFRAVLRGRAQWLTPVIPAVWEAEAGGCPEVRSWRPA

SEQ ID NO: 804343 - protein, 118 aa, Homo sapiens
SGRRLSQRLLGGCVRAPARRGGRALRVRPETWEEAGEKMPSESFCLAAQARLDSKWLKTDIQLAFTRDGLCGLWNEMVKDGEIVYTGTESTQNGELPPRKVETGFHRVSQDGLELLTS

SEQ ID NO: 804344 - protein, 4217 aa, Homo sapiens
MHLYFLGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNADLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYRYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESMDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDYTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 804345 - protein, 1796 aa, Homo sapiens
MHLYFLGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNADLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYRYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESMDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEVQPCSLDSF

SEQ ID NO: 804346 - protein, 4366 aa, Homo sapiens
MVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNADLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYRYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESMDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDYTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVV

SEQ ID NO: 804347 - protein, 2466 aa, Homo sapiens
MSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDYTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 804348 - protein, 3400 aa, Homo sapiens
PEVHIHPCPSFKCLFTGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESMDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDYTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 804349 - protein, 3145 aa, Homo sapiens
GGVLEVPHEVEAEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDYTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 804350 - protein, 2431 aa, Homo sapiens
KSAIYPLRVSSAFVCHPPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDYTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 804351 - protein, 217 aa, Homo sapiens
FFSGFRECLCKLLKSVRSSAYVFTCRPETWEEAGEKMPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKR

SEQ ID NO: 804352 - protein, 281 aa, Homo sapiens
FFSGFRECLCKLLKSVRSSAYVFTCRPETWEEAGEKMPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGTVPGVARCSASLIHQQTGFRTRFSHHVPFG

SEQ ID NO: 804353 - protein, 60 aa, Homo sapiens
DADTVSDEYSDEEVVEDVDDAAYSMVSASHVTARTWAAVRLRSNSLTPWLSLSLERINYI

SEQ ID NO: 804354 - protein, 206 aa, Homo sapiens
PEANGTWTGMVGELIARKADLAVAGLTITAEREKVIDFSKPFMTLGISILYRVHMGRKPGYFSFLDPFSPGVWLFMLLAYLAVSCVLFLVARWAFTLIIISSYTANLAAFLTVQRMDVPIESVDDLADQTAIEYGTIHGGSSMTFFQNSRYQTYQRMWNYMYSKQPSVFVKSTEEGIARVLNSNYAFLLESTMNEYYRQRNCNLTQ

SEQ ID NO: 804355 - protein, 118 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGGMCVG

SEQ ID NO: 804356 - protein, 382 aa, Homo sapiens
RQEFGTRALLVSVRALVRMVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 804357 - protein, 90 aa, Homo sapiens
RARYPSSIDIIDSAFESLRWDVCGLKFRAAVVHENTPFVVPHLRDVLGSVRSVPQEPWTLIYLAKFRPSLPFLSFPLLPIFLFFCPSILL

SEQ ID NO: 804358 - protein, 228 aa, Homo sapiens
YNRARYLIGSQDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATLKLGNNSLSCSRS

SEQ ID NO: 804359 - protein, 60 aa, Homo sapiens
MRIIWSKIKQKKKTGVFGGKEIRRASVSPLQERARGITDKEEGVMASNGHFLFLLFSPPT

SEQ ID NO: 804360 - protein, 364 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 804361 - protein, 364 aa, Homo sapiens; identical to SEQ ID NO: 804360

SEQ ID NO: 804362 - protein, 393 aa, Homo sapiens
MPGTPRSYGMKRPRREEEALLVSVRALVRMVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 804363 - protein, 364 aa, Homo sapiens; identical to SEQ ID NO: 804360

SEQ ID NO: 804364 - protein, 364 aa, Homo sapiens; identical to SEQ ID NO: 804360

SEQ ID NO: 804365 - protein, 364 aa, Homo sapiens; identical to SEQ ID NO: 804360

SEQ ID NO: 804366 - protein, 364 aa, Homo sapiens; identical to SEQ ID NO: 804360

SEQ ID NO: 804367 - protein, 364 aa, Homo sapiens; identical to SEQ ID NO: 804360

SEQ ID NO: 804368 - protein, 364 aa, Homo sapiens; identical to SEQ ID NO: 804360

SEQ ID NO: 804369 - protein, 364 aa, Homo sapiens; identical to SEQ ID NO: 804360

SEQ ID NO: 804370 - protein, 364 aa, Homo sapiens; identical to SEQ ID NO: 804360

SEQ ID NO: 804371 - protein, 364 aa, Homo sapiens; identical to SEQ ID NO: 804360

SEQ ID NO: 804372 - protein, 364 aa, Homo sapiens; identical to SEQ ID NO: 804360

SEQ ID NO: 804373 - protein, 384 aa, Homo sapiens
DVGLRFFVRCLVFLSQALVRMVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 804374 - protein, 364 aa, Homo sapiens; identical to SEQ ID NO: 804360

SEQ ID NO: 804375 - protein, 364 aa, Homo sapiens; identical to SEQ ID NO: 804360

SEQ ID NO: 804376 - protein, 346 aa, Homo sapiens
MVKLFIGNLPREATEQEIRSLFEQYGKVLECDIIKNYGFVHIEDKTAAEDAIRNLHHYKLHGVNINVEASKNKSELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 804377 - protein, 329 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATVWLSQSQCWEVRYG

SEQ ID NO: 804378 - protein, 339 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 804379 - protein, 264 aa, Homo sapiens
YNRARYLIGSQDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 804380 - protein, 224 aa, Homo sapiens [sequence omitted]

SEQ ID NO: 804381 - protein, 143 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGGMCVG

SEQ ID NO: 804382 - protein, 125 aa, Homo sapiens
MVKLFIGNLPREATEQEIRSLFEQYGKVLECDIIKNYGFVHIEDKTAAEDAIRNLHHYKLHGVNINVEASKNKSELRAKFEEYGPVIECDIVKDYAFVHMERAEDAVEAIRGLDNTEFQGGMCVG

SEQ ID NO: 804383 - protein, 143 aa, Homo sapiens; identical to SEQ ID NO: 804381

SEQ ID NO: 804384 - protein, 177 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGEPPSLGRGLNTRLCAENGWISKRRGLVKITAVGWLVMKK

SEQ ID NO: 804385 - protein, 181 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQVGSVRSVPQEPWTLIYLAKFRPSLPFLSFPLLPIFLFFCPSILL

SEQ ID NO: 804386 - protein, 239 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRHLLPTSGAAATAAAAAAAAAAVTAASTSYYGRDRSPLRRATAPVPTVGEGYGYGHESELSQASAAARNSRPSILL

SEQ ID NO: 804387 - protein, 150 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQDIQLCHPSCSVVA

SEQ ID NO: 804388 - protein, 139 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQAR

SEQ ID NO: 804389 - protein, 151 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGGVLLCCLGWSTVV

SEQ ID NO: 804390 - protein, 206 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGSCQDGEAVHRKPPREATEQEIRSLFEQYGKVLECDIIKNYGFVHIEDKTAAEDAIRNLHHYKLHGVNI

SEQ ID NO: 804391 - protein, 622 aa, Homo sapiens
FPAPEPPPGPGQGGPGAPPCCQPRGCGADQVAPAMAAEEEAAAGGKVLREENQCIAPVVSSRVSPGTRPTAMGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 804392 - protein, 656 aa, Homo sapiens
FPAPEPPPGPGQGGPGAPPCCQPRGCGADQVAPAMAAEEEAAAGGKVLREENQCIAPVVSSRVSPGTRPTAMGSFSSHMTEFPRKRKGSDSDPSQSGIMTEKVVEKLSQNPLTYLLSTRIEISASSGSREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 804393 - protein, 643 aa, Homo sapiens
FPAPEPPPGPGQGGPGAPPCCQPRGCGADQVAPAMAAEEEAAAGGKVLREENQCIAPVVSSRVSPGTRPTAMGSFSSHMTEFPRKRKGSDSDPSHQNPLTYLLSTRIEISASSGSREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 804394 - protein, 373 aa, Homo sapiens
FPAPEPPPGPGQGGPGAPPCCQPRGCGADQVAPAMAAEEEAAAGGKVLREENQCIAPVVSSRVSPGTRPTAMGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQR

SEQ ID NO: 804395 - protein, 552 aa, Homo sapiens
FPAPEPPPGPGQGGPGAPPCCQPRGCGADQVAPAMAAEEEAAAGGKVLREENQCIAPVVSSRVSPGTRPTAMGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTLYGGLGGPARDRTNKHDS

SEQ ID NO: 804396 - protein, 164 aa, Homo sapiens
FPAPEPPPGPGQGGPGAPPCCQPRGCGADQVAPAMAAEEEAAAGGKVLREENQCIAPVVSSRVSPGTRPTAMGSFSSHMTEFPRKRKGSDSDPSQSGIMTEKVVEKLSQNPLTYLLSTRIEISASSGSRVEDGEHQVKMKAFRSWLRESTPSSAVHPGVRSLYP

SEQ ID NO: 804397 - protein, 299 aa, Homo sapiens [sequence omitted]

SEQ ID NO: 804398 - protein, 223 aa, Homo sapiens
MLPESVKSKYQDLLAVEHQGVKLLENRHQQQSTFKPEEILYKTLGFSVAQATSSLISAGKGVFVTKGLVPKGAVVSMYPGTVYQKYEPIFFQSIGNPFIFRCLDGVLIDGNDKGISKVVYRSCNGRDRLGPLEMSDSTWLTSEIHNPLAVGQYVNNCSNDRAANVCYQEFDVPAVFPIELKQYLPNIAYSYDKQSPLRCVVLVALRDINQGEELFSNYYTIVS

SEQ ID NO: 804399 - protein, 273 aa, Homo sapiens
MVGFGLGTLRYVPEESKDKVISDEDVLGTLLKVFQALFLNDFNKQSEILTMLPESVKSKYQDLLAVEHQGVKLLENRHQQQSTFKPEEILYKTLGFSVAQATSSLISAGKGVFVTKGLVPKGAVVSMYPGTVYQKYEPIFFQSIGNPFIFRCLDGVLIDGNDKGISKVVYRSCNGRDRLGPLEMSDSTWLTSEIHNPLAVGQYVNNCSNDRAANVCYQEFDVPAVFPIELKQYLPNIAYSYDKQSPLRCVVLVALRDINQGEELFSNYYTIVS

SEQ ID NO: 804400 - protein, 445 aa, Homo sapiens
MYPNPLIYCTCWDPWNLGPRKLIKTPQLPRKNSTGSSKLTPLLPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVPWRRDQINRHWHDVLQQLLLMQVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 804401 - protein, 412 aa, Homo sapiens
MYPNPLIYCTCWDPWNLGPRKLIKTPQLPRKNSTGSSKLTPLLPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKTEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVPWRRDQINRHWHDVLQQLLLMQVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 804402 - protein, 196 aa, Homo sapiens
MYPNPLIYCTCWDPWNLGPRKLIKTPQLPRKNSTGSSKLTPLLPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRGDGKRIQVFEEYVSYVSGQYL

SEQ ID NO: 804403 - protein, 393 aa, Homo sapiens
MYPNPLIYCTCWDPWNLGPRKLIKTPQLPRKNSTGSSKLTPLLPAPKNHNYLQPTKPVVSPKMKIHSARQEETNKSFYEVINVSPGYQLVRNREQISVTLGDEMFDRKKRWESEIPDKGRFSRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVPWRRDQINRHWHDVLQQLLLMQVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 804404 - protein, 82 aa, Homo sapiens
GAWLNGLTRKRDFRVRPLLYQDSILGVKQDNAEGSVQQPCKGVEPQPTQGVSSWLFLANLIPRCSGQKYLHFHSCQVSAWLW

SEQ ID NO: 804405 - protein, 197 aa, Homo sapiens
GAWLNGLTRKRDFRVRPLLYQDSILGVKQDNAEGSVQQPCKGFSSALGRWAVPLPGPPGPPGPPLPEGKHEQPLTWEWRLLRGNCLYTSNVALWDLSGAPTHAGRVFMAFPGQSDTKMQWPEVPALPLLSSLCMAMVRKSSALGKEVGRRVKEMVMLVAPFRQSSSLSRTFSSRKVVKAHASLHGARLSPLSRNIRG

SEQ ID NO: 804406 - protein, 82 aa, Homo sapiens; identical to SEQ ID NO: 804404

SEQ ID NO: 804407 - protein, 241 aa, Homo sapiens
GAWLNGLTRKRDFRVRPLLYQDSILGVKQDNAEGSVQQPCKALCLRFQRADVLWALKSLLLAGVLATWSCWPVSHRVDAQRALDAGFSSALGRWAVPLPGPPGPPGPPLPEGKHEQPLTWEWRLLRGNCLYTSNVALWDLSGAPTHAGRVFMAFPGQSDTKMQWPEVPALPLLSSLCMAMVRKSSALGKEVGRRVKEMVMLVAPFRQSSSLSRTFSSRKVVKAHASLHGARLSPLSRNIRG

SEQ ID NO: 804408 - protein, 97 aa, Homo sapiens
GAWLNGLTRKRDFRVRPLLYQDSILGVKQDNAEGSVQQPCKALCLRFQRADVLWALKSLLLAGVLATWSCWPVSHRVDAQRALDAVYDKDMGVVWSL

SEQ ID NO: 804409 - protein, 144 aa, Homo sapiens
MLMPSQRTTSTFAAQTVPVLATDGRTSDFCKSASQFQLLRPATATTRSLWERHRELMSVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804410 - protein, 215 aa, Homo sapiens
DAWVDPRVKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGR

SEQ ID NO: 804411 - protein, 111 aa, Homo sapiens
EEKTILAEVRGWVLQGGPGGGGQRHYRGHTDCVRCLAVHPDGVRVASGQTAGVDKDGKPLQPVVHIWDSETLLKLQEIGLGAFERGVGALAFSAAESKGWPFLLVWVDDSK

SEQ ID NO: 804412 - protein, 928 aa, Homo sapiens
APGCFPFPSPRPWPPRLRRLLRRRRSEQPGGRMDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804413 - protein, 620 aa, Homo sapiens
SGSIWRFKVRGWVAGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804414 - protein, 785 aa, Homo sapiens
LGTVEAEYQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804415 - protein, 714 aa, Homo sapiens
AFSLPNSRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804416 - protein, 622 aa, Homo sapiens
VEKQTRLGSEAWVVPVGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804417 - protein, 1014 aa, Homo sapiens
APGCFPFPSPRPWPPRLRRLLRRRRSEQPGGRMDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGEQGVETCWKGGGQGGAQFGLGTLGVCRWVRVQKPEDPAQEAPRDREGLPGTRQWVPRLPERLKWCSSGPWVAVGEEVGLRPAAVLGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804418 - protein, 1041 aa, Homo sapiens
APGCFPFPSPRPWPPRLRRLLRRRRSEQPGGRMDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGEQGVETCWKGGGQGGAQFGLGTLGVCRWVRVQKPEDPAQEAPRDREGLPGTRQWVAAAAGAPEMDVALGRGWRWVGGRAEAGRCARRLAGRLRWDRHQLPVPLPQRARGGGGRRLLQSASLPVPVRSCQGEAAGIAGVGPVGPRAQPPPQLFPPAQAPSRMYGGHGSHVTSVRFTHDDSHLVSLGGKDASIFQWRVLGAGGAGPAPATPSRTPSLSPASSLDV

SEQ ID NO: 804419 - protein, 515 aa, Homo sapiens
RQCLALSPRLECSAGFHHIGQAGHKLLASGDPPALASQSAGITGMSHCTWPALRLLIFALPFDLYCLLSPPTEKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804420 - protein, 928 aa, Homo sapiens; identical to SEQ ID NO: 804412

SEQ ID NO: 804421 - protein, 317 aa, Homo sapiens
ASTDIDARDKFSLSPGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804422 - protein, 272 aa, Homo sapiens
MKDIILNSPSPLSQETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804423 - protein, 289 aa, Homo sapiens
NAVVTCLLHQSLSVCVSELLLFAIPKPTQGGLPGGLLTSCLFVFLSASTSLPSRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804424 - protein, 209 aa, Homo sapiens
MSWYGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 804425 - protein, 693 aa, Homo sapiens
APGCFPFPSPRPWPPRLRRLLRRRRSEQPGGRMDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGR

SEQ ID NO: 804426 - protein, 351 aa, Homo sapiens
APGCFPFPSPRPWPPRLRRLLRRRRSEQPGGRMDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGVLEVAARDITGGTQTAFDALLFTLMVFG

SEQ ID NO: 804427 - protein, 172 aa, Homo sapiens
MKDIILNSPSPLSQETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGEQGRGNLLEG

SEQ ID NO: 804428 - protein, 119 aa, Homo sapiens
MVKMTKSKTFQAYLPNCHRTYSCIHCRAHLANHDELISKSFQGSQGRAYLFNSVVNVGCGPAEERVLLTGLHAVADIYCENCKTTLGWKYEHAFESSQKYKEGKFIIELAHMIKDNGWE

SEQ ID NO: 804429 - protein, 119 aa, Homo sapiens; identical to SEQ ID NO: 804428

SEQ ID NO: 804430 - protein, 365 aa, Homo sapiens
GRHRLPVCFPPGGSRGLELADSSATGGRSLVSCFHVILSGTGRGGGLRSLSARTTTPASPGGKPPERRRLDGGGALGRSVARAPPTAAFLCWAPEPLRPGARADGGRAQLLPERRRVLVGHTPFLLFTREPSDMVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVVFPVPSLLGLQRSLLDDLYLLFWFFLMKKVTFRCLSSAISECLPQSLNLMKFNLLISFLLLWTVRLVSCLRSIHYAVGSKTFLISSKSFMVLCFIFKPIVY

SEQ ID NO: 804431 - protein, 734 aa, Homo sapiens
KLFTKSSWKSERQLPLQGLKSIKTTTEQLKQSEREKEKETTSNIWHLVLSTGFPRAPLGIESKIYWQTLLLNTQEGEPQCLLPTEAALCSQTVGCTAVSQAGVSGLFPSNHPFQEIQQPTRHWASAWLPFPPGRAALGIIPGNLPAPEQKPCWDPFLHQPWCGGCSIALPPPPPQPLATSLHPSLDSPTSQLTHPPAASVWVGSIISSSPCNLFPPQIHPVLLFTREPSDMVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 804432 - protein, 637 aa, Homo sapiens
GRHRLPVCFPPGGSRGLELADSSATGGRSLVSCFHVILSGTGRGGGLRSLSARTTTPASPGGKPPERRRLDGGGALGRSVARAPPTAAFLCWAPEPLRPGARADGGRAQLLPERRRVLVGHTPFLLFTREPSDMVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 804433 - protein, 406 aa, Homo sapiens
MSASFSIWARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 804434 - protein, 223 aa, Homo sapiens
MCEMLSTREARYRHCTQSFFGELVTRHVLSGLHQNPRLPEGKMFTINCIFHTNSSGMSHSYHGMLGTLLKSGFPNVSTIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 804435 - protein, 734 aa, Homo sapiens; identical to SEQ ID NO: 804431

SEQ ID NO: 804436 - protein, 734 aa, Homo sapiens; identical to SEQ ID NO: 804431

SEQ ID NO: 804437 - protein, 734 aa, Homo sapiens; identical to SEQ ID NO: 804431

SEQ ID NO: 804438 - protein, 384 aa, Homo sapiens
GRHRLPVCFPPGGSRGLELADSSATGGRSLVSCFHVILSGTGRGGGLRSLSARTTTPASPGGKPPERRRLDGGGALGRSVARAPPTAAFLCWAPEPLRPGARADGGRAQLLPERRRVLVGHTPFLLFTREPSDMVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVSFLDTAVDQPDTYCKAHLYTSTCHIPQRPRQEKIRLVLGLLPLKYKIVFLDNKIWTEVFSKCTECAVA

SEQ ID NO: 804439 - protein, 734 aa, Homo sapiens; identical to SEQ ID NO: 804431

SEQ ID NO: 804440 - protein, 734 aa, Homo sapiens; identical to SEQ ID NO: 804431

SEQ ID NO: 804441 - protein, 270 aa, Homo sapiens
MPRDNMASLIQRIARQACLTFRGSGGGRGASDRDAASGPEAPMQPGFPENLSKLKSLLTQLRAEDLNIAPRKATLQPLPPNLPPVTYMHIYETDGFSLGVFLLKSGTSIPLHDHPGMHGMLKVLYGTVRISCMDKLDAGGGQRPRALPPEQQFEPPLQPREREAVRPGVLRSRAEYTEASGPCILTPHRDNLHQIDAVEGPAAFLDILAPPYDPDDGRDCHYYRVLEPVRPKEASSSACDLPREVWLLETPQADDFWCEGEPYPGPKVFP

SEQ ID NO: 804442 - protein, 338 aa, Homo sapiens
RQLEPQYGAPLAVNCGGYFSSLYSRHYRWVSMARASVCGSAHRLGQRRRGRGRRKGGGRSRHAEEQPTMPRDNMASLIQRIARQACLTFRGSGGGRGASDRDAASGPEAPMQPGFPENLSKLKSLLTQLRAEDLNIAPRKATLQPLPPNLPPVTYMHIYETDGFSLGVFLLKSGTSIPLHDHPGMHGMLKVLYGTVRISCMDKLDAGGGQRPRALPPEQQFEPPLQPREREAVRPGVLRSRAEYTEASGPCILTPHRDNLHQIDAVEGPAAFLDILAPPYDPDDGRDCHYYRVLEPVRPKEASSSACDLPREVWLLETPQADDFWCEGEPYPGPKVFP

SEQ ID NO: 804443 - protein, 159 aa, Homo sapiens
MPRDNMASLIQRIARQACLTFRGSGGGRGASDRDAASGPEAPMQPGFPENLSKLKSLLTQLRAEDLNIARAAVRAAAAAPGARSRAAGRAAFAGRVHRGQRPLHPHTAPGQPAPDRRRGRACRLPGHPGPALRPGRWPGLPLLPGAGAGQAQGGLQLGL

SEQ ID NO: 804444 - protein, 270 aa, Homo sapiens; identical to SEQ ID NO: 804441

SEQ ID NO: 804445 - protein, 270 aa, Homo sapiens; identical to SEQ ID NO: 804441

SEQ ID NO: 804446 - protein, 228 aa, Homo sapiens
MQPGFPENLSKLKSLLTQLRAEDLNIAPRKATLQPLPPNLPPVTYMHIYETDGFSLGVFLLKSGTSIPLHDHPGMHGMLKVLYGTVRISCMDKLDAGGGQRPRALPPEQQFEPPLQPREREAVRPGVLRSRAEYTEASGPCILTPHRDNLHQIDAVEGPAAFLDILAPPYDPDDGRDCHYYRVLEPVRPKEASSSACDLPREVWLLETPQADDFWCEGEPYPGPKVFP

SEQ ID NO: 804447 - protein, 238 aa, Homo sapiens
MPRDNMASLIQRIARQACLTFRGSGGGRGASDRDAASGPEAPMQPGFPENLSKLKSLLTQLRAEDLNIAPRKATLQPSTPRPAAPASSHRTGTTCTRSTPWKGLPPSWTSWPRPTTRTMAGTATITGCWSRSGPRRPPARPVTCLERCGSWRPHRPMTSGARENPIQVPRSSLEATGAQERWAEDVPYPTTRAVSLPPSLGVGSTGMSSSRFLGSLGKHGRLDSSRRARLWGRGGRGG

SEQ ID NO: 804448 - protein, 469 aa, Homo sapiens
MEYHQPEDPAPGKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPEKQLQVDQDYLIALSLQQQQPRGPLGLTDLELAQQLQQEEYQQQQAAQPVRMRTRVLSLQGRGATSGRPAGERRQRPKHESDCILL

SEQ ID NO: 804449 - protein, 327 aa, Homo sapiens
MNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPEKQLQVDQDYLIALSLQQQQPRGPLGLTDLELAQQLQQEEYQQQQAAQPVRMRTRVLSLQGRGATSGRPAGERRQRPKHESDCILL

SEQ ID NO: 804450 - protein, 469 aa, Homo sapiens; identical to SEQ ID NO: 804448

SEQ ID NO: 804451 - protein, 469 aa, Homo sapiens; identical to SEQ ID NO: 804448

SEQ ID NO: 804452 - protein, 303 aa, Homo sapiens [sequence omitted]

SEQ ID NO: 804453 - protein, 250 aa, Homo sapiens
MAHLGNCLLSIKPQEKSEGLQLNFQQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPEKQLQVDQDYLIALSLQQQQPRGPLGLTDLELAQQLQQEEYQQQQAAQPVRMRTRVLSLQGRGATSGRPAGERRQRPKHESDCILL

SEQ ID NO: 804454 - protein, 414 aa, Homo sapiens [sequence omitted]

SEQ ID NO: 804455 - protein, 166 aa, Homo sapiens
GKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVREHAVRGAKNIREYSSLTYFLDHPD

SEQ ID NO: 804456 - protein, 469 aa, Homo sapiens; identical to SEQ ID NO: 804448

SEQ ID NO: 804457 - protein, 469 aa, Homo sapiens; identical to SEQ ID NO: 804448

SEQ ID NO: 804458 - protein, 469 aa, Homo sapiens; identical to SEQ ID NO: 804448

SEQ ID NO: 804459 - protein, 469 aa, Homo sapiens; identical to SEQ ID NO: 804448

SEQ ID NO: 804460 - protein, 469 aa, Homo sapiens; identical to SEQ ID NO: 804448

SEQ ID NO: 804461 - protein, 457 aa, Homo sapiens
MEYHQPEDPAPGKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPEKQLQVDQDYLIALSLQQQQPRGPLGLTDLELAQQLQQEEYQQQQAAQPVRMRTRVLSLQGRGATSDAHREFRI

SEQ ID NO: 804462 - protein, 231 aa, Homo sapiens
MEYHQPEDPAPGKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGHSYPSRRGALKSWRSGVSRGEGLS

SEQ ID NO: 804463 - protein, 97 aa, Homo sapiens
RLSPRRIPGVDLLAASLCLPSCAPFPASRCCWRALAGFFLPRPRDGGECGTEEPGLPTRWARAPKGPLGSERGGSPRGPRPSLASDCATLRSGLTGG

SEQ ID NO: 804464 - protein, 97 aa, Homo sapiens; identical to SEQ ID NO: 804463

SEQ ID NO: 804465 - protein, 97 aa, Homo sapiens; identical to SEQ ID NO: 804463

SEQ ID NO: 804466 - protein, 97 aa, Homo sapiens; identical to SEQ ID NO: 804463

SEQ ID NO: 804467 - protein, 122 aa, Homo sapiens
SALSPRRIPGVDLLAASLCLPSCAPFPASRCCWRALAGFFLPRPRDGGECGTEEPGLPTRWARAPKGPLGSERGGSPRGPRPSLASDCATLRSGLTGECCRQAAGFTEGVGVWEPVSWGMRG

SEQ ID NO: 804468 - protein, 97 aa, Homo sapiens; identical to SEQ ID NO: 804463

SEQ ID NO: 804469 - protein, 97 aa, Homo sapiens; identical to SEQ ID NO: 804463

SEQ ID NO: 804470 - protein, 97 aa, Homo sapiens; identical to SEQ ID NO: 804463

SEQ ID NO: 804471 - protein, 122 aa, Homo sapiens; identical to SEQ ID NO: 804467

SEQ ID NO: 804472 - protein, 97 aa, Homo sapiens; identical to SEQ ID NO: 804463

SEQ ID NO: 804473 - protein, 71 aa, Homo sapiens
SWRPELLFSMVIHSVTSPNYLVTVLAQTTELPFDTNCKFSDPLWIHAQSAYNTQDRSSREKESTFPRQMQH

SEQ ID NO: 804474 - protein, 491 aa, Homo sapiens
MDHTDNELQGTNSSGSLGGLDVRRRIPIKLISKQANKAKPAPRTQRTINRMPAKAPPGDEEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 804475 - protein, 491 aa, Homo sapiens; identical to SEQ ID NO: 804474

SEQ ID NO: 804476 - protein, 370 aa, Homo sapiens
MIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 804477 - protein, 441 aa, Homo sapiens
MPAKAPPGDEEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 804478 - protein, 491 aa, Homo sapiens; identical to SEQ ID NO: 804474

SEQ ID NO: 804479 - protein, 1382 aa, Homo sapiens
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 804480 - protein, 1382 aa, Homo sapiens; identical to SEQ ID NO: 804479

SEQ ID NO: 804481 - protein, 1250 aa, Homo sapiens
AGYFDLQSSLDCTNGGGGSLPRRKLRHWYRYGEVKILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSVVFTEHLLCAWEPKGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 804482 - protein, 728 aa, Homo sapiens
MTPRMVLCSDVPFRRRLRTSCRLRAESTLVRMVEPGSRTPSWVSSSGRRLGIWMGLTDDMLAAFRTGGCQKEPDRQLPPACPAVTKPQTRLHASASGYALRSVPGPKSHGFALLSEESLPNWQELKMTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEVSDLWPHACLSAGSPGPPKLQCPRRGPPLLSSSQGSEQVGFL

SEQ ID NO: 804483 - protein, 1382 aa, Homo sapiens; identical to SEQ ID NO: 804479

SEQ ID NO: 804484 - protein, 1522 aa, Homo sapiens
MTPRMVLCSDVPFRRRLRTSCRLRAESTLVRMVEPGSRTPSWVSSSGRRLGIWMGLTDDMLAAFRTGGCQKEPDRQLPPACPAVTKPQTRLHASASGYALRSVPGPKSHGFALLSEESLPNWQELKMTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSEVFTEHLLCAWEPKGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 804485 - protein, 836 aa, Homo sapiens
MHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSVVFTEHLLCAWEPKGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 804486 - protein, 1508 aa, Homo sapiens
MTPRMVLCSDVPFRRRLRTSCRLRAESTLVRMVEPGSRTPSWVSSSGRRLGIWMGLTDDMLAAFRTGGCQKEPDRQLPPACPAVTKPQTRLHASASGYALRSVPGPKSHGFALLSEESLPNWQELKMTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 804487 - protein, 363 aa, Homo sapiens
MKRSLNENSARSTAGCLPVPLFNQKKRNRQPLTSNPLKDDSGISTPSDNYDFPPLPTDWAWEAVNPELAPVMKTVDTGQIPHSVSRPLRSQDSVFNSIQSNTGRSQGGWSYRDGNKNTSLKTWNKNDFKPQCKRTNLVANDGKNSCPMSSGAQQQKQLRTPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 804488 - protein, 363 aa, Homo sapiens; identical to SEQ ID NO: 804487

SEQ ID NO: 804489 - protein, 184 aa, Homo sapiens
MKIQLEVQQKKRNRQPLTSNPLKDDSDWAWEAVNPELAPVMKTVDTGQIPHSVSRPLRSQDSVFNSIQSNTGRSQGGWSYRDGNKNTSLKTWNKNDFKPQCKRTNLVANDGKNSCPMSSGAQQQKQLRTPEPPNLSRNKETELLRQTHSSKISGCTMRGLDKNSALQTLKPNFQQNQYKKQMLG

SEQ ID NO: 804490 - protein, 363 aa, Homo sapiens; identical to SEQ ID NO: 804487

SEQ ID NO: 804491 - protein, 347 aa, Homo sapiens [sequence omitted]

SEQ ID NO: 804492 - protein, 494 aa, Homo sapiens
MPTESASCSTARQTKQKRKSHSLSIRRTNSSEQERTGLPRDMLEGQDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTSISGEDEVECSDKDEPDLDGDVSSDCPTIRVPLTSLKSHQGVVIASDWLVGGKQAVTASWDRTANLYDVETSELVHSLTGHDQELTHCCTHPTQRLVVTSSRDTTFRLWDFRDPSIHSVNVFQGHTDTVTSAVFTVGDNVVSGSDDRTVKVWDLKNMRSPIATIRTDSAINRINVCVGQKIIALPHDNRQVRLFDMSGVRLARLPRSSRQGHRRMVCCSAWSEDHPVCNLFTCGFDRQAIGWNINIPALLQEK

SEQ ID NO: 804493 - protein, 494 aa, Homo sapiens; identical to SEQ ID NO: 804492

SEQ ID NO: 804494 - protein, 494 aa, Homo sapiens; identical to SEQ ID NO: 804492

SEQ ID NO: 804495 - protein, 313 aa, Homo sapiens
MPTESASCSTARQTKQKRKSHSLSIRRTNSSEQERTGLPRDMLEGQDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSGKHCLRSAVARGRCLLQCVFKIVHDKASCYCVGSLTVSVVRGQCGLFRDWDNSVLSLYGLNNREKLNSLNNVHIMLVCILFNIVYNPYVGNFVTEMCALFFTKYISVLEVYF

SEQ ID NO: 804496 - protein, 461 aa, Homo sapiens
MSSDSEWDRSACSDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTSISGEDEVECSDKDEPDLDGDVSSDCPTIRVPLTSLKSHQGVVIASDWLVGGKQAVTASWDRTANLYDVETSELVHSLTGHDQELTHCCTHPTQRLVVTSSRDTTFRLWDFRDPSIHSVNVFQGHTDTVTSAVFTVGDNVVSGSDDRTVKVWDLKNMRSPIATIRTDSAINRINVCVGQKIIALPHDNRQVRLFDMSGVRLARLPRSSRQGHRRMVCCSAWSEDHPVCNLFTCGFDRQAIGWNINIPALLQEK

SEQ ID NO: 804497 - protein, 90 aa, Homo sapiens
PNTDRAVPARLPRGRHRGPERRRPRVSGLRRTAPRARSPPAPAAGLRGRWTRSAPPLIAGVTRTLPPRSNAHRKRKLFDCSPNKTEAQIP

SEQ ID NO: 804498 - protein, 161 aa, Homo sapiens
FVLFFHLKNYKLMIAKFRLLHFHLADHTALLWSIETGKCLVKYAGHVGSGKHCLRSAVARGRCLLQCVFKIVHDKASCYCVGSLTVSVVRGQCGLFRDWDNSVLSLYGLNNREKLNSLNNVHIMLVCILFNIVYNPYVGNFVTEMCALFFTKYISVLEVYF

SEQ ID NO: 804499 - protein, 199 aa, Homo sapiens [sequence omitted]

SEQ ID NO: 804500 - protein, 835 aa, Homo sapiens
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 804501 - protein, 184 aa, Homo sapiens
MPQSKSRKIAILGYRSVGKSSLTIQFVEGQFVDSYDPTIENTFTKLITVNGQEYHLELVDTAGQDEYSIFPQTYSIDINGYILVYSVTSIKSFEVIKVIHGKLLDMVGKVQIPIMLVGNKKDLHMERVISYEEGKALAESWNAAFLESSAKENQTAVDVFRRMILEAEKMDGAASQGKSSCSVM

SEQ ID NO: 804502 - protein, 904 aa, Homo sapiens
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGYIWEFKYLFVQCNYTLENLELHTTPWSSCECLFDDDIRAITFKAKFQKSAPSFVKISDLATHLEDKCSGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 804503 - protein, 904 aa, Homo sapiens; identical to SEQ ID NO: 804502

SEQ ID NO: 804504 - protein, 886 aa, Homo sapiens
MSGGSQVHIFWGAPIAPLKITVSEDTASLMSVADPWKKIQLLYSQHSLYLKDEKQHKNLEKNCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGYIWEFKYLFVQCNYTLENLELHTTPWSSCECLFDDDIRAITFKAKFQKSAPSFVKISDLATHLEDKCSGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 804505 - protein, 431 aa, Homo sapiens
MVGKVQIPIMLVGNKKDLHMERVISYEEGKALAESWNAAFLESSAKENQTAVDVFRRMILEAEKMDGAASQDSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGYIWEFKYLFVQCNYTLENLELHTTPWSSCECLFDDDIRAITFKAKFQKSAPSFVKISDLATHLEDKCSGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 804506 - protein, 904 aa, Homo sapiens; identical to SEQ ID NO: 804502

SEQ ID NO: 804507 - protein, 886 aa, Homo sapiens
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGYIWEFKYLFVQCNYTLENLELHTTPWSSCECLFDDDIRAITFKAKFQKSAPSFVKISDLATHLEDKCSGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDVVKHGANARL

SEQ ID NO: 804508 - protein, 904 aa, Homo sapiens; identical to SEQ ID NO: 804502

SEQ ID NO: 804509 - protein, 945 aa, Homo sapiens
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGYIWEFKYLFVQCNYTLENLELHTTPWSSCECLFDDDIRAITFKAKFQKSAPSFVKISDLATHLEDKCSGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIDGVLLLLPRLECCGAISVHHNLCLLDSSKSPASVSQVAGITVPSSEITYGMVVADLFHSLLAVSAEPCVLKIQSLFVLDENSYPLQQDFSLLDFYPDIVKHGANARL

SEQ ID NO: 804510 - protein, 514 aa, Homo sapiens [sequence omitted]

SEQ ID NO: 804511 - protein, 169 aa, Homo sapiens
MAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 804512 - protein, 169 aa, Homo sapiens; identical to SEQ ID NO: 804511

SEQ ID NO: 804513 - protein, 169 aa, Homo sapiens; identical to SEQ ID NO: 804511

SEQ ID NO: 804514 - protein, 228 aa, Homo sapiens
KARYEALGVIGRGTDERVAATEPKSELEPEERVFKKEVYLHTSPHLKADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 804515 - protein, 177 aa, Homo sapiens
LRLVRGLGCEAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 804516 - protein, 192 aa, Homo sapiens
MELVPATPHYPADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 804517 - protein, 283 aa, Homo sapiens
SYPMQPVTAPPSYPPTSYSSTQPTSYDQSSYSQQNTYGQPSSYGQQSSYGQQSSYGQQPPTSYPPQTGSYSQAPSQYSQQSSSYGQQMFKKEVYLHTSPHLKADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 804518 - protein, 192 aa, Homo sapiens; identical to SEQ ID NO: 804516

SEQ ID NO: 804519 - protein, 169 aa, Homo sapiens; identical to SEQ ID NO: 804511

SEQ ID NO: 804520 - protein, 238 aa, Homo sapiens
GDWKCPNPTCENMNFSWRNECNQCKAPKPDGPGGGPGGSHMGVFKKEVYLHTSPHLKADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 804521 - protein, 235 aa, Homo sapiens
YSQQSSQPYGQQSYSGYSQSTDTSGYGQSSYSSYGQSQNMFKKEVYLHTSPHLKADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 804522 - protein, 149 aa, Homo sapiens
MAAESLPFSFGTLSSWELEAWYEDLQEVLSSDENGGTYVSPPGNEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 804523 - protein, 551 aa, Homo sapiens
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVDYYFLSIGLVMLGKFGITSAFSMLYVFTAELYPTLVRNMAVGVTSTASRVGSIIAPYFVYLGAYNRMLPYIVMGSLTVLIGILTLFFPESLGMTLPETLEQMQKVKWFRSGKKTRDSMETEENPKVLITAF

SEQ ID NO: 804524 - protein, 612 aa, Homo sapiens
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWSWSMNAPGCGHTVPGTGLAPDRGQPGTSTDKLSAPPEHLPVVLPFSYKRKELSSEHPILGRFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVDYYFLSIGLVMLGKFGITSAFSMLYVFTAELYPTLVRNMAVGVTSTASRVGSIIAPYFVYLGAYNRMLPYIVMGSLTVLIGILTLFFPESLGMTLPETLEQMQKVKWFRSGKKTRDSMETEENPKVLITAF

SEQ ID NO: 804525 - protein, 505 aa, Homo sapiens
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWSWSMNAPGCGHTVPGTGLAPDRGQPGTSTDKLSAPPEHLPVVLPFSYKRKELSSEHPILGRFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVVSGSGPEDSHEVAVKLSVVISTPN

SEQ ID NO: 804526 - protein, 165 aa, Homo sapiens
MEHKDDDDDDVSFAKWMSSFWGHSWREEDQRGLRERHRLQATSHRKTSLPCPLPVLPRIPSSDCHPRRHSHEDQEFRCRSSDRLPRRHSHEDQEFRCRSHVRDYRKYSEDGVIQGGHWESKGRFPFPKLRNFQSPFERQLVLYEPKRFCLFGALKAERREMKENA

SEQ ID NO: 804527 - protein, 96 aa, Homo sapiens
SGLRESVGVSRSLRKPFFFLFAPLLFGRWTSGVPVVAGVVPSTFRKEGQMALLPTEAEEGRVYSGLRALKRSEWKKKQRHSTGMGGSGRRVVKAIG

SEQ ID NO: 804528 - protein, 165 aa, Homo sapiens; identical to SEQ ID NO: 804526

SEQ ID NO: 804529 - protein, 165 aa, Homo sapiens; identical to SEQ ID NO: 804526

SEQ ID NO: 804530 - protein, 403 aa, Homo sapiens
MSTSTSPAAMLLRRLRRLSWGSTAVQLFILTVVTFGLLAPLACHRLLHSYFYLRHWHLNQMSQEFLQQSLKEGEAALHYFEELPSANGSVPIVWQATPRPWLVITIITVDRQPGFHYVLQVVSQFHRLLQQCGPQCEGHQLFLCNVERSVSHFDAKLLSKYVPVANRYEGTEDDYGDDPSTNSFEKEKQDYVYCLESSLQTYNPDYVLMVEDDAVPEEQIFPVLEHLLRARFSEPHLRDALYLKLYHPERLQHYINPEPMRILEWVGVGMLLGPLLTWIYMRFASRPGFSWPVMLFFSLYSMGLVELVGRHYFLELRRLSPSLYSVVPASQCCTPAMLFPAPAARRTLTYLSQVYCHKGFGKDMALYSLLRAKGERAYVVEPNLVKHIGLFSSLRYNFHPSLL

SEQ ID NO: 804531 - protein, 403 aa, Homo sapiens; identical to SEQ ID NO: 804530

SEQ ID NO: 804532 - protein, 403 aa, Homo sapiens; identical to SEQ ID NO: 804530

SEQ ID NO: 804533 - protein, 205 aa, Homo sapiens
SLWLISWESILFLLTSPCHAAPQQGSPGGCHIGWKRRPCILEGSHRLPFRKRPEGHLDEPPPVPEPLNDIAKIQLFSFCFNIFSNGNSLLGCIFASQEKKGLQQPEPLRNAQEAEVSSTCFEDEVGASASPALLAFQQLAVGGDLHVQGQLDVHQLLVLTQEPSHVLLGLLQGLLKVHQLGPCILESQFSPLLCISNGRLQAGTL

SEQ ID NO: 804534 - protein, 394 aa, Homo sapiens
PCRGGLRAWGGRLRTAAAAVAAEPGGEAMAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 804535 - protein, 348 aa, Homo sapiens
ATERDSISKTKLKKVCSSLQYECQFPLSLSSSLCSVMWHQAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 804536 - protein, 149 aa, Homo sapiens
MKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVHLTACRVLSSSPEREAKHWEIGFKMAGNPGTAGGKDNM

SEQ ID NO: 804537 - protein, 316 aa, Homo sapiens
MKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 804538 - protein, 316 aa, Homo sapiens; identical to SEQ ID NO: 804537

SEQ ID NO: 804539 - protein, 344 aa, Homo sapiens
IPQPTAGLVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 804540 - protein, 394 aa, Homo sapiens; identical to SEQ ID NO: 804534

SEQ ID NO: 804541 - protein, 394 aa, Homo sapiens; identical to SEQ ID NO: 804534

SEQ ID NO: 804542 - protein, 394 aa, Homo sapiens; identical to SEQ ID NO: 804534

SEQ ID NO: 804543 - protein, 311 aa, Homo sapiens
PCRGGLRAWGGRLRTAAAAVAAEPGGEAMAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILRFMGRLQTLQARTWRIPQPSCSVP

SEQ ID NO: 804544 - protein, 132 aa, Homo sapiens
MKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGTRLFPLNT

SEQ ID NO: 804545 - protein, 257 aa, Homo sapiens
MNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 804546 - protein, 394 aa, Homo sapiens; identical to SEQ ID NO: 804534

SEQ ID NO: 804547 - protein, 132 aa, Homo sapiens
TPLDATADDVEDKKVMMVVDDRGNHCCLLFSFIFFFCRWGLTLSPRLECSGVILAHHILHLLGSIEPSRLSLLSGWDHRCMPPHLANFCVFGRDRVSPCCPAWSQTTELNNCPFSYPKAPITALCLSSTSIR

SEQ ID NO: 804548 - protein, 254 aa, Homo sapiens
PCRGGLRAWGGRLRTAAAAVAAEPGGEAMAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIILLITLRRMSDGFSKRMRNVRKL

SEQ ID NO: 804549 - protein, 110 aa, Homo sapiens
GQLRLLQNPTLCSLLFQELDLPGHRQGTDGRAPCQRVMMTQSLVCRCTRTTINYGFAHHGDENNTGHLEAPQGTAPTSPHASPARTQQRLPWDPHPRCDDRNPRWRGPGD

SEQ ID NO: 804550 - protein, 115 aa, Homo sapiens
KPMPPFLTCSVKRRHNLIAMLALSLRPVFAANIPCSLSPSHTGLPADPQTCHRAFTCAVPSAWNVPHLPSCLPSYFPLAHPSALCCVSLLQKSPHSSLQQHSPTPTSTRIRFLLL

SEQ ID NO: 804551 - protein, 270 aa, Homo sapiens
MRGQGRKESLSDSRDLDGSYDQLTGHPPGPTKKALKQRFLKLLPCCGPQALPSVSETLAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 804552 - protein, 252 aa, Homo sapiens
MRGQGRKESLSDSRDLDGSYDQLTGHPPGPTKKALKQRFLKLLPCCGPQALPSVSENSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 804553 - protein, 227 aa, Homo sapiens
MRGQGRKESLSDSRDLDGSYDQLTDSVDDEFELSTVCHRPEGLEQLQEQTKFTRKELQVLYRGFKNPGALSFQECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 804554 - protein, 220 aa, Homo sapiens
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 804555 - protein, 184 aa, Homo sapiens
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEEMLDIMKSIYDMMGKYTYPALREEAPREHVESFFQKMDRNKDGVVTIEEFIESCQKDENIMRSMQLFDNVI

SEQ ID NO: 804556 - protein, 275 aa, Homo sapiens
MRGQGRKESLSDSRDLDGSYDQLTGHPPGPTKKALKQRFLKLLPCCGPQALPSVSETLAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKVYPHPTPPWGLEGSKSLGIQ

SEQ ID NO: 804557 - protein, 303 aa, Homo sapiens
MRGQGRKESLSDSRDLDGSYDQLTGHPPGPTKKALKQRFLKLLPCCGPQALPSVSENSVDDEFELSTVCHRPEGLEQLQEQTKFTRKELQVLYRGFKNKSSLPSHEPRGESSGGLKIIPLPGSLGPWRVGAVNGRGFCLCPQPGALSFQECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKVQLPALYITLTWTQA

SEQ ID NO: 804558 - protein, 235 aa, Homo sapiens
ELRRRARRQTMNRCPRRCRSPLGQAARSLYQLVTGSLSPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 804559 - protein, 220 aa, Homo sapiens; identical to SEQ ID NO: 804554

SEQ ID NO: 804560 - protein, 220 aa, Homo sapiens; identical to SEQ ID NO: 804554

SEQ ID NO: 804561 - protein, 252 aa, Homo sapiens; identical to SEQ ID NO: 804552

SEQ ID NO: 804562 - protein, 285 aa, Homo sapiens
MRGQGRKESLSDSRDLDGSYDQLTGHPPGPTKKALKQRFLKLLPCCGPQALPSVSEIGRVFRFLGDSSLPSALAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 804563 - protein, 154 aa, Homo sapiens
MRGQGRKESLSDSRDLDGSYDQLTGHPPGPTKKALKQRFLKLLPCCGPQALPSVSETLAAPASLRPHRPRLLDPDSVDDEFELSTVCHRPEGLEQLQEQTKFTRKELQVLYRGFKNECPSGIVNEENFKQIYSQFFPQGGLCGWFVRDSSGNCR

SEQ ID NO: 804564 - protein, 262 aa, Homo sapiens
MRGQGRKESLSDSRDLDGSYDQLTGHPPGPTKKALKQRFLKLLPCCGPQALPSVSENSVDDEFELSTVCHRPEGLEQLQEQTKFTRKELQVLYRGFKNKSSLPSMSHVECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 804565 - protein, 220 aa, Homo sapiens; identical to SEQ ID NO: 804554

SEQ ID NO: 804566 - protein, 271 aa, Homo sapiens
QTTWLPGHPLFPTWGGHPPGPTKKALKQRFLKLLPCCGPQALPSVSETLAAPASLRPHRPRLLDPDSVDDEFELSTVCHRPEGLEQLQEQTKFTRKELQVLYRGFKNKSSLPSMSHVECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 804567 - protein, 184 aa, Homo sapiens
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEEMLDIMKSIYDMMGKYTYPALREEAPREHVESFFQKMDRNKDGVVTIEEFIESCQKVQLPALYITLTWTQA

SEQ ID NO: 804568 - protein, 201 aa, Homo sapiens
MRGQGRKESLSDSRDLDGSYDQLTGHPPGPTKKALKQRFLKLLPCCGPQALPSVSENSVDDEFELSTVCHRPEGLEQLQEQTKFTRKELQVLYRGFKNKSSLPSHEPRGESSGGLKIIPLPGSLGPWRVGAVNGRGFCLCPQPGALSFQECPSGIVNEENFKQIYSQFFPQGGEGTRPKGKQLSFSRLREGGILEELGMPR

SEQ ID NO: 804569 - protein, 655 aa, Homo sapiens
METYHTCLVGTSCSIPPLFILSVFRYGVRESMQVFLSFLTEAVVSVKKRGEVGGILKNDHSWLAGARARQDFATGSFLVHKTSTSRLALQSWLAPSVHYPPIQCPCLLGLSAKFCLKNVGFFFANFIKAFPFVFSCWWFRVKFSMNKRGKYTTLNLEEKMKVLSRIEAGRSLKSVMDEFGISKSTFYDIKKNKKLILDFVLKQDMPLVGAEKRKRTTGAKYGDVDDAVYMWYQQKRSAGVPVRGVELQAAAERFARCFGRTDFKASTGWLFRFRNRHAIGNRKGCGEQVLSSVSENVEPFRQKLSMIIKEEKLCLAQLYSGDETDLFWKSMPENSQASRKDICLPGKKINKERLSAFLCANADGTHKLKSIIIGKSKLPKSVKEDTSTLPVIYKPSKDVWFTRELFSEWFFQNFVPEVRHFQLNVLRFHDEDVRALLLLDSCPAHPSSESLTSEDGRIKCMFFPHNSSTLIQPMNQGVILSCKRLYRWKQLEESLVIFEESDDEQEKGDKGVSKIKIYNIKSAIFNWAKSWEEVKQITIANAWENLLYKKEPEYDFQGLEHGDYREILEKCGELETKLDDDRVWLNGDEEKGCLLKTKGGITKEVVQKGGEAEKQTAEFKLSAVRESLDYLLDFVDATPEFQRFHFTLCEFSDDS

SEQ ID NO: 804570 - protein, 511 aa, Homo sapiens
MNKRGKYTTLNLEEKMKVLSRIEAGRSLKSVMDEFGISKSTFYDIKKNKKLILDFVLKQDMPLVGAEKRKRTTGAKYGDVDDAVYMWYQQKRSAGVPVRGVELQAAAERFARCFGRTDFKASTGWLFRFRNRHAIGNRKGCGEQVLSSVSENVEPFRQKLSMIIKEEKLCLAQLYSGDETDLFWKSMPENSQASRKDICLPGKKINKERLSAFLCANADGTHKLKSIIIGKSKLPKSVKEDTSTLPVIYKPSKDVWFTRELFSEWFFQNFVPEVRHFQLNVLRFHDEDVRALLLLDSCPAHPSSESLTSEDGRIKCMFFPHNSSTLIQPMNQGVILSCKRLYRWKQLEESLVIFEESDDEQEKGDKGVSKIKIYNIKSAIFNWAKSWEEVKQITIANAWENLLYKKEPEYDFQGLEHGDYREILEKCGELETKLDDDRVWLNGDEEKGCLLKTKGGITKEVVQKGGEAEKQTAEFKLSAVRESLDYLLDFVDATPEFQRFHFTLCEFSDDS

SEQ ID NO: 804571 - protein, 511 aa, Homo sapiens; identical to SEQ ID NO: 804570

SEQ ID NO: 804572 - protein, 439 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQDAPIILSDSEEEEMIILEPDKNPKKIRTQTTSAKQEKAPSKKPVKRRKKKRAAN

SEQ ID NO: 804573 - protein, 439 aa, Homo sapiens; identical to SEQ ID NO: 804572

SEQ ID NO: 804574 - protein, 439 aa, Homo sapiens; identical to SEQ ID NO: 804572

SEQ ID NO: 804575 - protein, 412 aa, Homo sapiens [sequence omitted]

SEQ ID NO: 804576 - protein, 456 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQELGFHHVGQTGLEFLTSDAPIILSDSEEEEMIILEPDKNPKKIRTQTTSAKQEKAPSKKPVKRRKKKRAAN

SEQ ID NO: 804577 - protein, 456 aa, Homo sapiens; identical to SEQ ID NO: 804576

SEQ ID NO: 804578 - protein, 426 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQELGFHHVGQTGLEFLTSGNPPASAYQNVGIKSVSHHAQPQK

SEQ ID NO: 804579 - protein, 387 aa, Homo sapiens [sequence omitted]

SEQ ID NO: 804580 - protein, 293 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKAFTDGERGERKGDERRDECGVWRSRV

SEQ ID NO: 804581 - protein, 367 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQDAPIILSDSEEEEMIILEPDKNPKKIRTQTTSAKQEKAPSKKPVKRRKKKRAAN

SEQ ID NO: 804582 - protein, 412 aa, Homo sapiens [sequence omitted]

SEQ ID NO: 804583 - protein, 402 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQEHRPPVQNKKKHQVKSQ

SEQ ID NO: 804584 - protein, 423 aa, Homo sapiens
MNLCLQRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQDAPIILSDSEEEEMIILEPDKNPKKIRTQTTSAKQEKAPSKKPVKRRKKKRAAN

SEQ ID NO: 804585 - protein, 393 aa, Homo sapiens
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQDAPIILSDSEEEEMIILEPDKNPKKIRTQTTSAKQEKAPSKKPVKRRKKKRAAN

SEQ ID NO: 804586 - protein, 84 aa, Homo sapiens
GAVADTVPFPLARSVLELGSGASLTGLAICKICRPRAYIFSDCHSRVLEQLQGNVLLNGLSLEADITANLDSPRVTMAQRWTGT

SEQ ID NO: 804587 - protein, 647 aa, Homo sapiens
EKWRRSLAVGPSLEKRSGNDCLASSLNLLDAGETQSPAVYFAIPAKEDTEGLAQMFQVFKKFNPAWERVCTILVDPHFLPLPILAMEFPTAEVLLSAFHICKFLQAKFYQLSLERPVERLLLTSLQSTMCSATAGNLRKLYTLLSNCIPPAKLPELHSHWLLNDRIWLAHRWRSRAESSHYFQSLEVTTHILSQFFGTTPSEKQGMASLFRYMQQNSADKANFNQGLCAQNNHAPSDTIPESPKLEQLVESHIQHSLNAICTGPAAQLCLGELAVVQKSTHLIGSGSEKMNIQILEDTHKVQPQPPASCSCYFNQAFHLPCRHILAMLSARRQVLQPDMLPAQWTAGCATSLDSILGSKWSETLDKHLAVTHLTEEVGQLLQHCTKEEFERRYSTLAGTGRQLDWAFMSRSNSDYSRCPEMLMHLCTLTSTHTHTHTHTHTHTHSLTLLYFRGPSFQNKDNKDKVEGSSHLPWPATQHVSSSMRQESAILICLVSLVELRVCHLLLAELEHPCAQVVHQVGGVCVCVMWNMAVNLNRFPCPLLCRQHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 804588 - protein, 134 aa, Homo sapiens
MVNLHPPCSASAWEEVGPGFAGSGLQPGWPRDGQSTGPFWCGSGEPRGYGTQWLCPWLFALGQGSVWQPLSFTWNLGSQVGWWLSAALHEVGAPLIPRPALPSALLAPGWAVQTAQPCSLQDTLFPGPAIHQAG

SEQ ID NO: 804589 - protein, 488 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 804590 - protein, 515 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCISVGGVCVCVMWNMAVNLNRFPCPLLCRQHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 804591 - protein, 521 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVSADRWRMHRTGGDSGMWGKVLELGAQPPPPCQVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 804592 - protein, 488 aa, Homo sapiens; identical to SEQ ID NO: 804589

SEQ ID NO: 804593 - protein, 257 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKADTSTSPCFDGAAASGWPGQGCSWPRPSSTSTW

SEQ ID NO: 804594 - protein, 120 aa, Homo sapiens
MWNMAVNLNRFPCPLLCRQHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 804595 - protein, 488 aa, Homo sapiens; identical to SEQ ID NO: 804589

SEQ ID NO: 804596 - protein, 195 aa, Homo sapiens
MAGGGRGNRTRRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRSPGTRGPRVAESGSDPAEVILSTAPEPTGAGSWGWGGGLGEGLWQYAGTRLRWLRD

SEQ ID NO: 804597 - protein, 442 aa, Homo sapiens
LPAHLGLGSGCELLSSGPVARCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 804598 - protein, 488 aa, Homo sapiens; identical to SEQ ID NO: 804589

SEQ ID NO: 804599 - protein, 394 aa, Homo sapiens
SQGAHYSQGAHYSQGAHYSQGAHYSQESSLLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 804600 - protein, 345 aa, Homo sapiens
MVRGWVLEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 804601 - protein, 74 aa, Homo sapiens
RCALADEWKRMFRLWAFTGMMAQIPLAWFVGRFFQGNYGNAAVWLSLIIGQPIAVLMYVHDYYVLNYEAPAAEA

SEQ ID NO: 804602 - protein, 538 aa, Homo sapiens
MEGGRRARVVIESKRNFFLGAFPTPFPAEHVELGRLGDSETAMVPGKGGADYILLPFKKMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 804603 - protein, 464 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 804604 - protein, 496 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRFHFCRMSWAEANSQCQTQSVPFWRRVDHLLIRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 804605 - protein, 496 aa, Homo sapiens; identical to SEQ ID NO: 804604

SEQ ID NO: 804606 - protein, 479 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 804607 - protein, 479 aa, Homo sapiens; identical to SEQ ID NO: 804606

SEQ ID NO: 804608 - protein, 479 aa, Homo sapiens; identical to SEQ ID NO: 804606

SEQ ID NO: 804609 - protein, 335 aa, Homo sapiens
MEGGRRARVVIESKRNFFLGAFPTPFPAEHVELGRLGDSETAMVPGKGGADYILLPFKKMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGTVEPKREK

SEQ ID NO: 804610 - protein, 464 aa, Homo sapiens; identical to SEQ ID NO: 804603

SEQ ID NO: 804611 - protein, 395 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 804612 - protein, 519 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGRNNLTAGIGKTYSKIETDKSLHITVVSNQILFGVSPFNSERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 804613 - protein, 252 aa, Homo sapiens
MKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 804614 - protein, 479 aa, Homo sapiens; identical to SEQ ID NO: 804606

SEQ ID NO: 804615 - protein, 276 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGFENVFSWW

SEQ ID NO: 804616 - protein, 261 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGFENVFSWW

SEQ ID NO: 804617 - protein, 276 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGTVEPKREK

SEQ ID NO: 804618 - protein, 220 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKDFGQSLPNEKQTSGILSDHQQSQFCKSTGESAQTSQH

SEQ ID NO: 804619 - protein, 213 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQEEEEILNI

SEQ ID NO: 804620 - protein, 82 aa, Homo sapiens
ESQRRRSPCQPFIGSGTHEVQLVPGTVHSLKQLKGLSPDTDATLSRMHGPGLTLSMEEVGSARGGRMVARDTESLVLGLWLS

SEQ ID NO: 804621 - protein, 227 aa, Homo sapiens
MASPSRQPPPGGSGLLQGSRARSYGSLVQSACSPVRERRLEHQLEPGDTLAGLALKYGVTMEQIKRANRLYTNDSIFLKKTLYIPILTEPRDLFNGLDSEEEKDGEEKVHPSNSEVWPHSTERKKQETGAGRANGEVLPTPGQETPTPIHDLSASDFLKKLDSQISLSKKAAAQKLKKGENGVPGEDAGLHLSSPWMQQRAVLGPVPLTRTSRTRTLRDQEDEIFKL

SEQ ID NO: 804622 - protein, 98 aa, Homo sapiens
ASCTVAAPKFEEEGAKWWEAAGLPEGEALGTRREHSRTPTFRAGRTPAARPRRAPGPENHREGRDEERRRVASGQGLCDYIGPIQIIQDHLPISRFFT

SEQ ID NO: 804623 - protein, 132 aa, Homo sapiens
APVARWPPPNSRRKVQSGGRLRVSRRVRRWGPGGSTAEPLPFGRGGHQPRALAGRRDRKITAKGGTRKGGGWLQDKDFVITLGPSRSSRIIFPSQDSSLNHICKIPFAVCEISVGEDVMPEDVASTLKQSRT

SEQ ID NO: 804624 - protein, 551 aa, Homo sapiens
MSRQSSITFQSGSRRGFSTTSAITPAAGRSRFSSVSVARSAAGSGGLGRISSAGASFGSRSLYNLGGAKRVSINGCGSSCRSGFGGRASNGFGVNSGFGYGGGVGGGFSGPSFPVCPPGGIQEVTVNQSLLTPLHLQIDPTIQRVRAEEREQIKTLNNKFASFIDKVRFLEQQNKVLETKWALLQEQGSRTVRQNLEPLFDSYTSELRRQLESITTERGRLEAELRNMQDVVEDFKVRYEDEINKRTAAENEFVALKKDVDAAYMNKVELEAKVKSLPEEINFIHSVFDAELSQLQTQVGDTSVVLSMDNNRNLDLDSIIAEVKAQYEDIANRSRAEAESWYQTKYEELQVTAGRHGDDLRNTKQEISEMNRMIQRLRAEIDSVKKQCSSLQTAIADAEQRGELALKDARAKLVDLEEALQKAKQDMARLLREYQELMNIKLALDVEIATYRKLLEGEECRLSGEGVSPVNISVVTSTLSSGYGSGSSIGGGNLGLGGGSGYSFTTSGGHSLGAGLGGSGFSATSNRGLGGSGSSVKFVSTTSSSQKSYTH

SEQ ID NO: 804625 - protein, 103 aa, Homo sapiens
APATFDLHNIISPFQEMTFEQDLKENQMPSPDHCLVIPWHFVHLSISSHLTSPSLLYVLPSEACSWLHQSNVNNKMKNIRMIRDQEYYRCPTLPPGIPKEARF

SEQ ID NO: 804626 - protein, 218 aa, Homo sapiens
MALVPYEETTEFGLQKFHKPLATFSFANHTIQIRQDWRHLGVAAVVWDAAIVLSTYLEMGAVELRGRSAVELGAGTGLVGIVAALLGAHVTITDRKVALEFLKSNVQANLPPHIQTKTVVKELTWGQNLGSFSPGEFDLILGADIIYLEETFTDLLQTLEHLCSNHSVILLACRIRYERDNNFLAMLERQFIVRKVHYDPEKDVHIYEAQKRNQKEDL

SEQ ID NO: 804627 - protein, 218 aa, Homo sapiens; identical to SEQ ID NO: 804626

SEQ ID NO: 804628 - protein, 129 aa, Homo sapiens
MALVPYEETTEFGLQKFHKPLATFSFANHTIQIRQDWRHLGVAAVVWDAAIVLSTYLEMGAVELRGRSAVELGAGTGLVGIVAALLGAHVTITDRKVALEFLKSNVQANLPPHIQTKTVVKELTWGPYI

SEQ ID NO: 804629 - protein, 127 aa, Homo sapiens
MALVPYEETTEFGLQKFHKPLATFSFANHTIQIRQDWRHLGVAAVVWDAAIVLSTYLEMGAVELRGRSAVELGAGTGLVGIVAALLENTGQMQTEGYSKRKQITTLQKLQGHQRQGNKLSQTEGDYN

SEQ ID NO: 804630 - protein, 109 aa, Homo sapiens
MALVPYEETTEFGLQKFHKPLATFSFANHTIQIRQDWRHLGVAAVVWDAAIVLSTYLEMGAVELRGRSAVELGAGTGLVGIVAALLENTGQMQTEGYSKRKQITTLHYN

SEQ ID NO: 804631 - protein, 95 aa, Homo sapiens
LRPAVFAASPGRGKRSARSTRDRLPGRKYRRGGASARPGRALGAPPGSSRRPVWPGDPKRPCDPPRLVSLSPLEGCRSSGAPGQEGRTGRPGRGV

SEQ ID NO: 804632 - protein, 254 aa, Homo sapiens
LRPAVFAASPGRGKRSARSTRDRLPGRLSRGRGAGGMALVPYEETTEFGLQKFHKPLATFSFANHTIQIRQDWRHLGVAAVVWDAAIVLSTYLEMGAVELRGRSAVELGAGTGLVGIVAALLGAHVTITDRKVALEFLKSNVQANLPPHIQTKTVVKELTWGQNLGSFSPGEFDLILGADIIYLEETFTDLLQTLEHLCSNHSVILLACRIRYERDNNFLAMLERQFIVRKVHYDPEKDVHIYEAQKRNQKEDL

SEQ ID NO: 804633 - protein, 218 aa, Homo sapiens; identical to SEQ ID NO: 804626

SEQ ID NO: 804634 - protein, 107 aa, Homo sapiens
MALVPYEETTEFGLQKFHKPLATFSFANHTIQIRQDWRHLGVAAVVWDAAIVLSTYLEMGAVELRGRSAVELGAGTGLVGIVAALLGCGQASPFSTLTGENLNPKLI

SEQ ID NO: 804635 - protein, 345 aa, Homo sapiens [sequence omitted]

SEQ ID NO: 804636 - protein, 345 aa, Homo sapiens [sequence omitted]

SEQ ID NO: 804637 - protein, 345 aa, Homo sapiens [sequence omitted]

SEQ ID NO: 804638 - protein, 304 aa, Homo sapiens
MSVTGGKMAPSLTQEILSHLGLASKTAAWGTLGTLRTFLNFSVDKDAQRLLRAITGQGVDRSAIVDVLTNRSREQRQLISRNFQERTQQDLMKSLQAALSGNLERIVMALLQPTAQFDAQELRTALKASDSAVDVAIEILATRTPPQLQECLAVYKHNFQVEAVDGITSETSGILQDLLLALAKGGRDSYSGIIDYNLAEQDVQALQRAEGPSREETWVPVFTQRNPEHLIRVFDQYQRSTGQELEEAVQNRFHGDAQVALLGLASVIKNTPLYFADKLHQALQDAVKGDCQSALLALCRAEDM

SEQ ID NO: 804639 - protein, 305 aa, Homo sapiens
QLSSSTRLGVIWPPRCAGMAASLWMGDLEPYMDENFISRAFATMGETVMSVKIIRNRLTGIPAGYCFVEFADLATAEKCLHKINGKPLPGATPAKRFKLNYATYGKQPDNSPEYSLFVGDLTPDVDDGMLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEDPMPQLDVTEANKEFMEQSEELYDALMDCHWQPLDTVSSEIPAMM

SEQ ID NO: 804640 - protein, 287 aa, Homo sapiens
MAASLWMGDLEPYMDENFISRAFATMGETVMSVKIIRNRLTGIPAGYCFVEFADLATAEKCLHKINGKPLPGATPAKRFKLNYATYGKQPDNSPEYSLFVGDLTPDVDDGMLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEDPMPQLDVTEANKEFMEQSEELYDALMDCHWQPLDTVSSEIPAMM

SEQ ID NO: 804641 - protein, 177 aa, Homo sapiens
MLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEDPMPQLDVTEANKEFMEQSEELYDALMDCHWQPLDTVSSEIPAMM

SEQ ID NO: 804642 - protein, 177 aa, Homo sapiens; identical to SEQ ID NO: 804641

SEQ ID NO: 804643 - protein, 177 aa, Homo sapiens; identical to SEQ ID NO: 804641

SEQ ID NO: 804644 - protein, 294 aa, Homo sapiens
MAASLWMGDLEPYMDENFISRAFATMGETVMSVKIIRNRLTGIPAGYCFVEFADLATAEKCLHKINGKPLPGATPAKRFKLNYATYGKQPDNSPEYSLFVGDLTPDVDDGMLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEEAGFHHVAQAGLELLGSSDLPISAFQSAGIIGMSHCSWPKLFLRPHATAGCD

SEQ ID NO: 804645 - protein, 135 aa, Homo sapiens
EREREREREREREREREASRVKPVEYSQMYSYSYNQYYQQYQNYYAQWGYDQNTGSYSYSYPQYGYTQSTMQTYEEVGDDALEEAGFHHVAQAGLELLGSSDLPISAFQSAGIIGMSHCSWPKLFLRPHATAGCD

SEQ ID NO: 804646 - protein, 305 aa, Homo sapiens; identical to SEQ ID NO: 804639

SEQ ID NO: 804647 - protein, 177 aa, Homo sapiens; identical to SEQ ID NO: 804641

SEQ ID NO: 804648 - protein, 177 aa, Homo sapiens; identical to SEQ ID NO: 804641

SEQ ID NO: 804649 - protein, 171 aa, Homo sapiens [sequence omitted]

SEQ ID NO: 804650 - protein, 311 aa, Homo sapiens
MAASLWMGDLEPYMDENFISRAFATMGETVMSVKIIRNRLTGIPAGYCFVEFADLATAEKCLHKINGKPLPGATPAKRFKLNYATYGKQPDNSPEYSLFVGDLTPDVDDGMLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEEAGFHHVAQAGLELLGSSDLPISAFQSAGIIGMSHCSWPKLFLRPHDTAGPDSGLQVDMFHSVKLRPAK

SEQ ID NO: 804651 - protein, 164 aa, Homo sapiens
VCPWIRPRQGGAADAGRDRAEATVLPSPPGPTQPRPVGSCPQLLNFLSCLRLLERMAANSWSREFFSWAGRTLSPIFLWVADVSLVVEAELGQRVVLEEGPEDGQDAFACDVVGVQVEAGDGLVGLEHDGNGKGHVVIGSRVGQGEQLNHSVELQSLSKPDQDL

SEQ ID NO: 804652 - protein, 88 aa, Homo sapiens
AGCSWLLGHGTVSFPSIDNCEKKAIRTHSGVAGLFTVKSSAMSLSLRTAATASAMAKNTDDPRNIPDSPRPCKKAHWCKKLPYYTTSF

SEQ ID NO: 804653 - protein, 123 aa, Homo sapiens
MKRDARKKREARKQANRTIPTSEQEKMGACWQSWGLAVVTLNLLFGVFMSGGKNRDHMEPTQEALAVHSKQEDNSKEAAHSLLSFPVHLPLSVRLLIYGEPNCVYLPSSHPQINVFRKIGHQQ

SEQ ID NO: 804654 - protein, 175 aa, Homo sapiens
RRRRCRRCSPGPSSWPPPPPGRAVTRRGGASPSPRAAAAAAAAAAAGAVGLSPPPAPLTRGSRPPISASLPAQDETSVSSEDFDMSDSTWMSADPHLASSLSPSQDERMRSPQNLHSQEDGPHRLSHLSQGLNIICSLDTSLRARNPRVSAERNDFSFRGRSRCVTSNSLAKDGY

SEQ ID NO: 804655 - protein, 347 aa, Homo sapiens
RRRRCRRCSPGPSSWPPPPPGRAVTRRGGASPSPRAAAAAAAAAAAGAVGLSPPPAPLTRGSRPPISASLPAQDETSVSSEDFDMSDSTWMSADPHLASSLSPSQDERMRSPQNLHSQEDDDSSSESGSGNGSSTLNPSTSSSTQGDPAFPEMNGNGAVAPMDFTTAAEDQPINLCDKLPPATALGTASYPSDGCGADGLRSRVKYGVKTTPEVLVLASAEETADTLLSAQQPREPVPPLQLWELDSIKTEVSGCPEDLTVGRAPTADDDDDDHDDHEDNDKMNDSEGMDPERLKAFNMFVRLFVDENLDRMVPISKQPKEKIQAIIESCSRQFPEFQERARKRIRT

SEQ ID NO: 804656 - protein, 175 aa, Homo sapiens; identical to SEQ ID NO: 804654

SEQ ID NO: 804657 - protein, 660 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 804658 - protein, 660 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 804659 - protein, 110 aa, Homo sapiens
DLDCHCHLGRCLLRCQLVVAMNPDLRRERDSASFNPELLTHILDGSPEKTRRRREIENMILNDPDFQHEDLNFLTRSQRYEVAVRKSAIMVKKMREFGIADPDEIMWFKK

SEQ ID NO: 804660 - protein, 660 aa, Homo sapiens; identical to SEQ ID NO: 804657

SEQ ID NO: 804661 - protein, 660 aa, Homo sapiens; identical to SEQ ID NO: 804658

SEQ ID NO: 804662 - protein, 660 aa, Homo sapiens; identical to SEQ ID NO: 804657

SEQ ID NO: 804663 - protein, 660 aa, Homo sapiens; identical to SEQ ID NO: 804658

SEQ ID NO: 804664 - protein, 555 aa, Homo sapiens
MFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 804665 - protein, 673 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGREVNFSAFIGCFEVGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 804666 - protein, 551 aa, Homo sapiens
AKEETGIGEAQQKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 804667 - protein, 338 aa, Homo sapiens
MLGTPETAADALLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 804668 - protein, 660 aa, Homo sapiens; identical to SEQ ID NO: 804657

SEQ ID NO: 804669 - protein, 660 aa, Homo sapiens; identical to SEQ ID NO: 804657

SEQ ID NO: 804670 - protein, 210 aa, Homo sapiens
MFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPG

SEQ ID NO: 804671 - protein, 66 aa, Homo sapiens
SGHCTPSSLGNKNETPSQKKQKKVELLKACLLVTFRFLMKSYDQVHSGKLVCGMVSYLNDLPSQRI

SEQ ID NO: 804672 - protein, 502 aa, Homo sapiens
RSHSRRCRRSGVAPPSPALLPGISPEPAPREKEPGSIRPHCPDSRLDSVLSAPAGLRSSGARGAVVAAAPGMFHSPRRLCSALLQRDAPGLRRLPAPGLRRPLSPPAAVPRPASPRLLAAASAASGAARSCSRTVCSMGTGTSRLYSALAKTLNSSAASQHPEYLVSPDPEHLEPIDPKELLEECRAVLHTRPPRFQRDFVDLRTDCPSTHPPIRVMQWNILAQALGEGKDNFVQCPVEALKWEERKCLILEEILAYQPDILCLQEVDHYFDTFQPLLSRLGYQGTFFPKPWSPCLDVEHNNGPDGCALFFLQNRFKLVNSANIRLTAMTLKTNQVAIAQTLECKESGRQFCIAVTHLKARTGWERFRSAQGCDLLQNLQNITQGAKIPLIVCGDFNAEPTEEVYKHFASSSLNLNSAYKLLSADGQSEPPYTTWKIRTSGECRHTLDYIWYSKHALNVRSALDLLTEEQIGPNRLPSFNYPSDHLSLVCDFSFTEESDGLS

SEQ ID NO: 804673 - protein, 174 aa, Homo sapiens [sequence omitted]

SEQ ID NO: 804674 - protein, 241 aa, Homo sapiens
PSSRGLGLNRPRSGVAPPSPALLPGISPEPAPREKEPGSIRPHCPDSRLDSVLSAPAGLRSSGARGAVVAAAPGMFHSPRRLCSALLQRDAPGLRRLPAPGLRRPLSPPAAVPRPASPRLLAAASAASGAARSCSRTVCSMGTGTSRLYSALAKTLNSSAASQHPEYLVSPDPEHLEPIDPKELLEECRAVLHTRPPRFQRDFVDLRTDCPSTHPPIRVMQWNILAQGMLDAFVPLQSSLL

SEQ ID NO: 804675 - protein, 74 aa, Homo sapiens
GIRIPVVIIFAMIFSMILSCAIPRNPEMVYKSLYIPEQESLPMKIGRNFFFIFRFCFFTFLFQRIVLEKPSLWK

SEQ ID NO: 804676 - protein, 74 aa, Homo sapiens; identical to SEQ ID NO: 804675

SEQ ID NO: 804677 - protein, 313 aa, Homo sapiens
MTSCHIAEEHIQKVAIFGGTHGNELTGVFLVKHWLENGAEIQRTGLEVKPFITNPRAVKKCTRYIDCDLNRIFDLENLGKKMSEDLPYEVRRAQEINHLFGPKDSEDSYDIIFDLHNTTSNMGCTLILEDSRNNFLIQMFHYIKTSLAPLPCYVYLIEHPSLKYATTRSIAKYPVGIEVGPQPQGVLRADILDQMRKMIKHALDFIHHFNEGKEFPPCAIEVYKIIEKVDYPRDENGEIAAIIHPNLQDQDWKPLHPGDPMFLTLDGKTIPLGGDCTVYPVFVNEAAYYEKKEAFAKTTKLTLNAKSIRCCLH

SEQ ID NO: 804678 - protein, 313 aa, Homo sapiens; identical to SEQ ID NO: 804677

SEQ ID NO: 804679 - protein, 69 aa, Homo sapiens
LGTELKPRFRWRPWKAESRQRGSAGAAGACGREAPVSRRDALQGKPRGVRPWALSSRLPGKEDCGFLAL

SEQ ID NO: 804680 - protein, 313 aa, Homo sapiens; identical to SEQ ID NO: 804677

SEQ ID NO: 804681 - protein, 313 aa, Homo sapiens; identical to SEQ ID NO: 804677

SEQ ID NO: 804682 - protein, 69 aa, Homo sapiens
TQRGCWAPRLSPDRSNISRYARCDQCCIQEMREDGQTPGSRKMVKGRIGNPTDRSSSQENPTHESGSSP

SEQ ID NO: 804683 - protein, 76 aa, Homo sapiens
TQRGCWAPRLSPDRSNISRYARCDQCCIQEMREDGQTPGSRKMILHGKIQQSLLLLDEVQSHIFKDHQAVTYPRYV

SEQ ID NO: 804684 - protein, 185 aa, Homo sapiens
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKIYTPVEESSIGKFPRCTTIDFMMYRSIR

SEQ ID NO: 804685 - protein, 90 aa, Homo sapiens
GAPALPARLRFFRDQLELVEPSGWIHVPLTDNHKKPTRTFMIQIAVLANHQNGRDTHMRQIKIYTPVEESSIGKFPRCTTIDFMMYRSIR

SEQ ID NO: 804686 - protein, 96 aa, Homo sapiens
REGQFLDRRPFGPFPQDFCFYESARRGENRIHVPLTDNHKKPTRTFMIQIAVLANHQNGRDTHMRQIKIYTPVEESSIGKFPRCTTIDFMMYRSIR

SEQ ID NO: 804687 - protein, 222 aa, Homo sapiens
TSLSCDPCSTPLAKPAAGGAENLSFGKQPGLETNILKMTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKIYTPVEESSIGKFPRCTTIDFMMYRSIR

SEQ ID NO: 804688 - protein, 196 aa, Homo sapiens
MGGVKETNILKMTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKIYTPVEESSIGKFPRCTTIDFMMYRSIR

SEQ ID NO: 804689 - protein, 219 aa, Homo sapiens
MRSTFLEWASYSLQNLEAIFLTLSSMVRAYNILKMTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKIYTPVEESSIGKFPRCTTIDFMMYRSIR

SEQ ID NO: 804690 - protein, 206 aa, Homo sapiens
QECRHEAEFCNQPGLETNILKMTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKIYTPVEESSIGKFPRCTTIDFMMYRSIR

SEQ ID NO: 804691 - protein, 185 aa, Homo sapiens; identical to SEQ ID NO: 804684

SEQ ID NO: 804692 - protein, 179 aa, Homo sapiens
TSLSCDPCSTPLAKPAAGGAENLSFGKQPGLETNILKMTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRVAAFLPLKLRRLGQQNVMSWEQEAKMLPVDHQG

SEQ ID NO: 804693 - protein, 204 aa, Homo sapiens
TSLSCDPCSTPLAKPAAGGAENLSFGKQPGLETNILKMTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQITIDFMMYRSIR

SEQ ID NO: 804694 - protein, 126 aa, Homo sapiens
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRPHVLHVNEESMNLQVSG

SEQ ID NO: 804695 - protein, 222 aa, Homo sapiens; identical to SEQ ID NO: 804687

SEQ ID NO: 804696 - protein, 222 aa, Homo sapiens; identical to SEQ ID NO: 804687

SEQ ID NO: 804697 - protein, 120 aa, Homo sapiens
TSLSCDPCSTPLAKPAAGGAENLSFGKQPGLETNILKMTTPNKTPPGADPKQLERTGTVREIGSQAVWSLSSCKPGFGVDQLRDDNLETYWQSDGSQPHLVNIQFSNLSWWNQVAGFMFP

SEQ ID NO: 804698 - protein, 151 aa, Homo sapiens
TSLSCDPCSTPLAKPAAGGAENLSFGKQPGLETNILKMTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRALVSG

SEQ ID NO: 804699 - protein, 196 aa, Homo sapiens; identical to SEQ ID NO: 804688

SEQ ID NO: 804700 - protein, 196 aa, Homo sapiens; identical to SEQ ID NO: 804688

SEQ ID NO: 804701 - protein, 114 aa, Homo sapiens
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRALVSG

SEQ ID NO: 804702 - protein, 120 aa, Homo sapiens; identical to SEQ ID NO: 804697

SEQ ID NO: 804703 - protein, 126 aa, Homo sapiens; identical to SEQ ID NO: 804694

SEQ ID NO: 804704 - protein, 821 aa, Homo sapiens
MRRGSSDSCASGSQVAGTTVAGPAHPESLTLCSGEAERRGKEEWPDSHHYPGPTPAPESSDGPHKVTVLATMLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLVRWVEARREAPTGRDQGSGDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 804705 - protein, 731 aa, Homo sapiens
MLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 804706 - protein, 182 aa, Homo sapiens
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHVNLPFLCEGQDPPCPPSPLFLLHINIFLFLNILLPSPPPATLRDF

SEQ ID NO: 804707 - protein, 502 aa, Homo sapiens
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 804708 - protein, 547 aa, Homo sapiens
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 804709 - protein, 456 aa, Homo sapiens
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALG

SEQ ID NO: 804710 - protein, 456 aa, Homo sapiens; identical to SEQ ID NO: 804709

SEQ ID NO: 804711 - protein, 430 aa, Homo sapiens
MEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 804712 - protein, 322 aa, Homo sapiens
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 804713 - protein, 437 aa, Homo sapiens
MRRGSSDSCASGSQVAGTTVAGPAHPESLTLCSGEAERRGKEEWPDSHHYPGPTPAPESSDGPHKVTVLATMLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHVNLPFLCEGQDPPCPPSPLFLLHINIFLFLNILLPSPPPATLRDF

SEQ ID NO: 804714 - protein, 92 aa, Homo sapiens
GDSEDPRLYHQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 804715 - protein, 129 aa, Homo sapiens
MRDPVTTTPLITCHPPSPFLFPGPKLFHGSLEELSQALPSRAQASSEQPPPLPRKMCRSVSTDNLSPSLLKPFQEGPSGRSLSQEDLPSEASASTVSHSSSELGPVLGTGQTAPLSSGDSPGDDKHKNK

SEQ ID NO: 804716 - protein, 69 aa, Homo sapiens
LRRAPVSDAGTGFPPHSTSPDQVFGCQLESLCQREGDTVPSFLRLCIAAVDKRGHFLRDPRILFQQAKA

SEQ ID NO: 804717 - protein, 107 aa, Homo sapiens
VEARREAPTGRDQGSGVGTIGVRSSWGQGGLSGEPLPGPGCGTPAVGQSPARDTDFSPLSPSTRPAPGLGSGEPPGAASVGLWTRGAERRGGRRRGVGAGVQAAAAP

SEQ ID NO: 804718 - protein, 41 aa, Homo sapiens
VVPAPHCPLRTQIPCPPGQGCGRGLGSGQSRNERAFFFHSW

SEQ ID NO: 804719 - protein, 192 aa, Homo sapiens
IGGLCLPLNSRKPPALGGRQQVRLGEGLAGRPGWSLSLVGTQFLRRENGEGEWTAPVGSVPLGRRCFRSFPRGNPTRTGKETHHRSGNGREPWTGGMGPSPNRAGRGVPQSPPSGLSLHLCTMGALAFSLSSWGWWQGGEGSRGSSGVGLGGASGCVWAGGVARVAVVTGEVRLSVWDLCEIRSPSNNPRSL

SEQ ID NO: 804720 - protein, 152 aa, Homo sapiens
LVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 804721 - protein, 70 aa, Homo sapiens
GGGFCFLAIGVLELWVLATNFRDYAIIFTQLEFGDEPFNTVELYSLTETASQEAMGLFTKWSRSLGFLSQ

SEQ ID NO: 804722 - protein, 122 aa, Homo sapiens
LASLLAGLAWTPELQSPLTGPRGLDPEWVTGPFFSRLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 804723 - protein, 66 aa, Homo sapiens
LVSVPRAQAVWLGRLDPEQLLGPWYVLAVASREKGFAMEKDMKNVVGVVVTLTPENNLRTLSSQHG

SEQ ID NO: 804724 - protein, 112 aa, Homo sapiens
MASGGWEAPPGNNPVPPQLEQEVERRQRLGQESAARKALIASSYHPARPEVYDSLQDAALAPEFLAVTEYSVSPDADLKGLLQRLETVSGPSKKEQPLLAFLLGDRGSQSHF

SEQ ID NO: 804725 - protein, 373 aa, Homo sapiens
MASTDLGNIGFYGKLRSGCGCFTMATVGAPRHFCRCACFCTDNLYVARYGLHVRFRGEQQLRRDYGPILRSRGCVSAKDFQQLLAELEQEVERRQRLGQESAARKALIASSYHPARPEVYDSLQDAALAPEFLAVTEYSVSPDADLKGLLQRLETVSEEKRIYRVPVFTAPFCQALLEELEHFEQSDMPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 804726 - protein, 186 aa, Homo sapiens
MPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 804727 - protein, 186 aa, Homo sapiens; identical to SEQ ID NO: 804726

SEQ ID NO: 804728 - protein, 186 aa, Homo sapiens; identical to SEQ ID NO: 804726

SEQ ID NO: 804729 - protein, 186 aa, Homo sapiens; identical to SEQ ID NO: 804726

SEQ ID NO: 804730 - protein, 186 aa, Homo sapiens; identical to SEQ ID NO: 804726

SEQ ID NO: 804731 - protein, 186 aa, Homo sapiens; identical to SEQ ID NO: 804726

SEQ ID NO: 804732 - protein, 186 aa, Homo sapiens; identical to SEQ ID NO: 804726

SEQ ID NO: 804733 - protein, 163 aa, Homo sapiens
MASTDLGNIGFYGKLRSGCGCFTMATVGAPRHFCRCACFCTDNLYVARYGLHVRFRGEQQLRRDYGPILRSRGCVSAKDFQQLLAELEQEVERRQRLGQESAARKALIASSYHPARPEVYDSLQDAALAPEFLAVTEYSVSPDADLKGLLQRLETVSGVRSWP

SEQ ID NO: 804734 - protein, 290 aa, Homo sapiens
MVELEQEVERRQRLGQESAARKALIASSYHPARPEVYDSLQDAALAPEFLAVTEYSVSPDADLKGLLQRLETVSEEKRIYRVPVFTAPFCQALLEELEHFEQSDMPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 804735 - protein, 373 aa, Homo sapiens; identical to SEQ ID NO: 804725

SEQ ID NO: 804736 - protein, 186 aa, Homo sapiens; identical to SEQ ID NO: 804726

SEQ ID NO: 804737 - protein, 373 aa, Homo sapiens; identical to SEQ ID NO: 804725

SEQ ID NO: 804738 - protein, 186 aa, Homo sapiens; identical to SEQ ID NO: 804726

SEQ ID NO: 804739 - protein, 397 aa, Homo sapiens
MASTDLGNIGFYGKLRSGCGCFTMATVGAPRHFCRCACFCTDNLYVARYGLHVRFRGEQQLRRDYGPILRSRGCVSAKDFQQLLAELEQEVERRQRLGQESAARKALIASSYHPARPEVYDSLQDAALAPEFLAVTEYSVSPDADLKGLLQRLETVSEEKRIYRVPVFTAPFCQALLEELEHFEQSDMPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQVSCDPCGRAWGSCECPGLSRAILQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 804740 - protein, 381 aa, Homo sapiens
MASTDLGNIGFYGKLRSGCGCFTMATVGAPRHFCRCACFCTDNLYVARYGLHVRFRGEQQLRRDYGPLEQEVERRQRLGQESAARKALIASSYHPARPEVYDSLQDAALAPEFLAVTEYSVSPDADLKGLLQRLETVSGDETGRLKPRPGRPTAHSGQQTIPPSTEEKRIYRVPVFTAPFCQALLEELEHFEQSDMPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 804741 - protein, 186 aa, Homo sapiens; identical to SEQ ID NO: 804726

SEQ ID NO: 804742 - protein, 83 aa, Homo sapiens
QAEYRSREYRILRKLVAAVGASLWRRWGLRGTSAAAPASAPITCTWRAMGCTCASEASSSCAGTTARSCAAEAVLAPRTSSSC

SEQ ID NO: 804743 - protein, 283 aa, Homo sapiens
PSSRSPQGWSLSEEPASSPLSSVSADDEWLDNMESGKMAPPKNAPRDALVMAQILKDMGITEYEPRVINQMLEFAFRYVTTILDDAKIYSSHAKKPNVDADDVRLAIQCRADQSFTSPPPRDFLLDIARQKNQTPLPLIKPYAGPRLPPDRYCLTAPNYRLKSLIKKGPNQGRLVPRLSVGAVSSKPTTPTIATPQTVSVPNKVATPMSVTSQRFTVQIPPSQSTPVKPVPATTAVQNVLINPSMIGPKNILITTNMVSSQNTANEANPLKRKHEDDDDNDIM

SEQ ID NO: 804744 - protein, 251 aa, Homo sapiens
MESGKMAPPKNAPRDALVMAQILKDMGITEYEPRVINQMLEFAFRYVTTILDDAKIYSSHAKKPNVDADDVRLAIQCRADQSFTSPPPRDFLLDIARQKNQTPLPLIKPYAGPRLPPDRYCLTAPNYRLKSLIKKGPNQGRLVPRLSVGAVSSKPTTPTIATPQTVSVPNKVATPMSVTSQRFTVQIPPSQSTPVKPVPATTAVQNVLINPSMIGPKNILITTNMVSSQNTANEANPLKRKHEDDDDNDIM

SEQ ID NO: 804745 - protein, 857 aa, Homo sapiens
MRSFAWGSSGDHVGDKSEEAPGAWDEVSAVGALLQRPPHPGAGRRAWALVGAPASGQGLAGSATNSRVVSRESKLKNMATSNLLKNKGSLQFEDKWDFMRPIVLKLLRQESVTKQQWFDLFSDVHAVCLWDDKGPAKIHQALKEDILEFIKQAQARVLSHQDDTALLKAYIVEWRKFFTQCDILPKPFCQLEITLMGKQGSNKKSNVEDSIVRKLMLDTWNESIFSNIKNRLQDSAMKLVHAERLGEAFDSQLVIGVRESYVNLCSNPEDKLQIYRDNFEKAYLDSTERFYRTQAPSYLQQNGVQNYMKYADAKLKEEEKRALRYLETRRECNSVEALMECCVNALVTSFKETILAECQGMIKRNETEKLHLMFSLMDKVPNGIEPMLKDLEEHIISAGLADMVAAAETITTDSEKYVEQLLTLFNRFSKLVKEAFQDDPRFLTARDKAYKAVVNDATIFKLELPLKQKGVGLKTQPESKCPELLANYCDMLLRKTPLSKKLTSEEIEAKLKEVLLVLKYVQNKDVFMRYHKAHLTRRLILDISADSEIEENMVEWLREVGMPADYVNKLARMFQDIKVSEDLNQAFKEMHKNNKLALPADSVNIKILNAGAWSRSSEKVFVSLPTELEDLIPEVEEFYKKNHSGRKLHWHHLMSNGIITFKNEVGQYDLEVTTFQLAVLFAWNQRPREKISFENLKLATELPDAELRRTLWSLVAFPKLKRQVLLYEPQVNSPKDFTEGTLFSVNQEFSLIKNAKVQKRGKINLIGRLQLTTERMREEENEGIVQLRILRTQEAIIQIMKMRKKISNAQLQTELVEILKNMFLPQKKMIKEQIEWLIEHKYIRRDESDINTFIYMA

SEQ ID NO: 804746 - protein, 857 aa, Homo sapiens; identical to SEQ ID NO: 804745

SEQ ID NO: 804747 - protein, 857 aa, Homo sapiens; identical to SEQ ID NO: 804745

SEQ ID NO: 804748 - protein, 857 aa, Homo sapiens; identical to SEQ ID NO: 804745

SEQ ID NO: 804749 - protein, 798 aa, Homo sapiens
MRSFAWGSSGDHVGDKSEEAPGAWDEVSAVGALLQRPPHPGAGRRAWALVGAPASGQGLAGSATNSRVVSRESKLKNMATSNLLKNKGSLQFEDKWDFMRPIVLKLLRQESVTKQQWFDLFSDVHAVCLWDDKGPAKIHQALKEDILEFIKQAQALMLDTWNESIFSNIKNRLQDSAMKLVHAERLGEAFDSQLVIGVRESYVNLCSNPEDKLQIYRDNFEKAYLDSTERFYRTQAPSYLQQNGVQNYMKYADAKLKEEEKRALRYLETRRECNSVEALMECCVNALVTSFKETILAECQGMIKRNETEKLHLMFSLMDKVPNGIEPMLKDLEEHIISAGLADMVAAAETITTDSEKYVEQLLTLFNRFSKLVKEAFQDDPRFLTARDKAYKAVVNDATIFKLELPLKQKGVGLKTQPESKCPELLANYCDMLLRKTPLSKKLTSEEIEAKLKEVLLVLKYVQNKDVFMRYHKAHLTRRLILDISADSEIEENMVEWLREVGMPADYVNKLARMFQDIKVSEDLNQAFKEMHKNNKLALPADSVNIKILNAGAWSRSSEKVFVSLPTELEDLIPEVEEFYKKNHSGRKLHWHHLMSNGIITFKNEVGQYDLEVTTFQLAVLFAWNQRPREKISFENLKLATELPDAELRRTLWSLVAFPKLKRQVLLYEPQVNSPKDFTEGTLFSVNQEFSLIKNAKVQKRGKINLIGRLQLTTERMREEENEGIVQLRILRTQEAIIQIMKMRKKISNAQLQTELVEILKNMFLPQKKMIKEQIEWLIEHKYIRRDESDINTFIYMA

SEQ ID NO: 804750 - protein, 857 aa, Homo sapiens; identical to SEQ ID NO: 804745

SEQ ID NO: 804751 - protein, 473 aa, Homo sapiens
MRSFAWGSSGDHVGDKSEEAPGAWDEVSAVGALLQRPPHPGAGRRAWALVGAPASGQGLAGSATNSRVVSRESKLKNMATSNLLKNKGSLQFEDKWDFMRPIVLKLLRQESVTKQQWFDLFSDVHAVCLWDDKGPAKIHQALKEDILEFIKQAQARVLSHQDDTALLKAYIVEWRKFFTQCDILPKPFCQLEITLMGKQGSNKKSNVEDSIVRKLMLDTWNESIFSNIKNRLQDSAMKLVHAERLGEAFDSQLVIGVRESYVNLCSNPEDKLQIYRDNFEKAYLDSTERFYRTQAPSYLQQNGVQNYMKYADAKLKEEEKRALRYLETRRECNSVEALMECCVNALVTSFKETILAECQGMIKRNETEKLHLMFSLMDKVPNGIEPMLKDLEEHIISAGLADMVAAAETITTDSEKYVEQLLTLFNRFSKLVKEAFQDDPRFLTARDKTQLKEYFPWSFLDVLPPSTAHHQQS

SEQ ID NO: 804752 - protein, 69 aa, Homo sapiens
QGGWPAGQWRPTPLPAALRASLFGNPKPQDGGGGSQQRSQFLTCSIVPLSEELPVIFFARKSLKFEIPE

SEQ ID NO: 804753 - protein, 69 aa, Homo sapiens; identical to SEQ ID NO: 804752

SEQ ID NO: 804754 - protein, 60 aa, Homo sapiens
METEVGRWKRTQSQGMQMESCSAAQAGVQWTDLGSLQRPSSGFKRFSCFSLSSSWDYRRP

SEQ ID NO: 804755 - protein, 131 aa, Homo sapiens
MEHSPASTLISGLLTPRISPGRNHLSSCLEGSFCWIWSDLCMMDFGNPVEGCSLIAPICHYRTMRLPFIYSICFYPDLLCCCRPSSSCYNTGLSVLRPWARVVWNRSHITAHVESSKPKLGGTPGTRLLGS

SEQ ID NO: 804756 - protein, 323 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804757 - protein, 323 aa, Homo sapiens; identical to SEQ ID NO: 804756

SEQ ID NO: 804758 - protein, 323 aa, Homo sapiens; identical to SEQ ID NO: 804756

SEQ ID NO: 804759 - protein, 323 aa, Homo sapiens; identical to SEQ ID NO: 804756

SEQ ID NO: 804760 - protein, 323 aa, Homo sapiens; identical to SEQ ID NO: 804756

SEQ ID NO: 804761 - protein, 323 aa, Homo sapiens; identical to SEQ ID NO: 804756

SEQ ID NO: 804762 - protein, 322 aa, Homo sapiens
PSLSLSLSLSCQPSEDMLTSPSPSFMMVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804763 - protein, 364 aa, Homo sapiens
MWQPLFFKWLLSCCPGSSQIAAAASTQPEDDINTQRKKSQEKMREVTDSPGRPRELTIPQTSSHGANRFVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804764 - protein, 332 aa, Homo sapiens
FAFHSNENIGINFLWSDSKWETTHARQQMNGTMPHPYKILLLIYMPECTDFCPNINTSTNNIAALKKNEKDISYDSIYVKALKNNEQIYGDQSLAGVGVVAELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804765 - protein, 360 aa, Homo sapiens
RYTANGYSQLSSMVVNHDVNGHCCLLLLIRATNSPCSRDSVNSYRSYVRESAKIEAGINARCSPILSAEDQMVERIICESLRVESRTHLHEHKNCMNGTMSSEIRRSYIISVYRCWLDADIPDSYQTYLSPGGITLERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804766 - protein, 297 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804767 - protein, 202 aa, Homo sapiens
MDSKYQCVKLNDGHFMPVLGFGTYAPAEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804768 - protein, 305 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALARVVVLAKSYNEQRIRQNVQVFEFQLTSEEMKAIDGLNRNVRYLTLDIFAGPPNYPFSDEY

SEQ ID NO: 804769 - protein, 148 aa, Homo sapiens
DHLQLPAVEVGHPDGVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 804770 - protein, 146 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKVGSLCDQINFTFVLSINIVFMEI

SEQ ID NO: 804771 - protein, 34 aa, Homo sapiens
MEKCKDAGLAKSIGVSNFNHRLLEMILNKPGLKY

SEQ ID NO: 804772 - protein, 3018 aa, Homo sapiens
REYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFTSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTRSDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENMGKGTPLPVTPEMERVKHNQENISSVLYKENVGKATATPVTPEMQRVKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804773 - protein, 3049 aa, Homo sapiens
REYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFTSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENVGKATATPVTPEMQRVKRNQENISSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804774 - protein, 2142 aa, Homo sapiens
VNAVNRIMSELFHDVKPGTLPVVNWKTLKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENVGKATATPVTPEMQRVKRNQENISSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804775 - protein, 3018 aa, Homo sapiens
REYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFTSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804776 - protein, 788 aa, Homo sapiens
MKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENVGKATATPVTPEMQRVKRNQENISSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804777 - protein, 437 aa, Homo sapiens
MRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENVGKATATPVTPEMQRVKRNQENISSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804778 - protein, 388 aa, Homo sapiens
MGKGTPLPVTPEMERVKHNQENISSVLYKENMGKGTPLPVTPEMERVKHNQENISSVLYKENVGKATATPVTPEMQRVKRNQENISSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804779 - protein, 462 aa, Homo sapiens
MVYMRITLVDSVIFQGAPSTSCRCQSRSHRHEKTFSSVLYKENMGKGTPLPVTPEMERVKHNQENISSVLYKENMGKGTPLPVTPEMERVKHNQENISSVLYKENMGKGTPLPVTPEMERVKHNQENISSVLYKENVGKATATPVTPEMQRVKRNQENISSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804780 - protein, 419 aa, Homo sapiens
MGKGTPLPVTPEMERVKHNQENISSVLYKENMGKGTPLPVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 804781 - protein, 247 aa, Homo sapiens [sequence omitted]

SEQ ID NO: 804782 - protein, 2878 aa, Homo sapiens
REYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFTSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENVGKATATPVTPEMQRVKRNQENISSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGN

SEQ ID NO: 804783 - protein, 2732 aa, Homo sapiens
REYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFTSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVFLRGPKKKKSLNFI

SEQ ID NO: 804784 - protein, 2605 aa, Homo sapiens
REYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFTSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVYLLFILHLMLT

SEQ ID NO: 804785 - protein, 2580 aa, Homo sapiens
REYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFTSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKKKNSRDVHLFLADC

SEQ ID NO: 804786 - protein, 296 aa, Homo sapiens
MGKGTPLPVTPEMERVKHNQENISSVLYKENMGKGTPLPVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINGKASRGPGPGSKSPNLQWH

SEQ ID NO: 804787 - protein, 127 aa, Homo sapiens
MRSRSKSPRRPSPTARGANCDVELLKTTTRDREELKCMLEKYERHLAEIQGNVKVLKSERDKIFLLYEQAGEIPIRRECESVEASSHGIASREGEKNVYDRDADGLRRNGKGEEARKGGSLKKLERL

SEQ ID NO: 804788 - protein, 84 aa, Homo sapiens
ARDAAPPPEGRPPEAQEKEGRAGIAPSLSACGAVGSRQPAGVLSKGPSGREPGSRQGRRLRSNKSTEGHKAPVQMGLPRVTAQR

SEQ ID NO: 804789 - protein, 84 aa, Homo sapiens; identical to SEQ ID NO: 804788

SEQ ID NO: 804790 - protein, 84 aa, Homo sapiens; identical to SEQ ID NO: 804788

SEQ ID NO: 804791 - protein, 74 aa, Homo sapiens
ARDAAPPPEGRPPEAQEKEGRAGIAPSLSACGAVGSRQPAGVLNDNTGWSGSENTLRLLIIPICQLTAVGKKTL

SEQ ID NO: 804792 - protein, 697 aa, Homo sapiens [sequence omitted]

SEQ ID NO: 804793 - protein, 697 aa, Homo sapiens [sequence omitted]

SEQ ID NO: 804794 - protein, 697 aa, Homo sapiens [sequence omitted]

SEQ ID NO: 804795 - protein, 697 aa, Homo sapiens [sequence omitted]

SEQ ID NO: 804796 - protein, 697 aa, Homo sapiens [sequence omitted]

SEQ ID NO: 804797 - protein, 875 aa, Homo sapiens
MVTTKEYDFGLGAPVSEAENYQNTLQLEQEVRNQDRFISTLKLQIEDLKQTNHGLEEYVRKLLDSKEVVSSQVDDLTSHNEHLCKELIKIDQLAEQLEKEKNFVVDSANKELEEAKIDLICQQNNIIVLEDTIKRLKSIILDTEKAQNKSPSRLDSFVKTLEADKDHYKSEAQHLRKMMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 804798 - protein, 697 aa, Homo sapiens [sequence omitted]

SEQ ID NO: 804799 - protein, 697 aa, Homo sapiens [sequence omitted]

SEQ ID NO: 804800 - protein, 715 aa, Homo sapiens
MRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEEGRKGNLLLGSTNRKRENFNLCYRDF

SEQ ID NO: 804801 - protein, 540 aa, Homo sapiens
MEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 804802 - protein, 406 aa, Homo sapiens
MKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 804803 - protein, 104 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRRRILRRGQQDIFTEI

SEQ ID NO: 804804 - protein, 211 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 804805 - protein, 211 aa, Homo sapiens; identical to SEQ ID NO: 804804

SEQ ID NO: 804806 - protein, 168 aa, Homo sapiens [sequence omitted]

SEQ ID NO: 804807 - protein, 158 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNSITNDAREDEMEENLTQVGSILGNLKDMALNIGNEIDAQNPQIKRITDKADTNRDRIDIANARAKKLIDS

SEQ ID NO: 804808 - protein, 179 aa, Homo sapiens
MLDEQKEQLNRIEEGLDQINKDMRETEKTLTELNKCCGLCVCPCNRFSDVGCFYETRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 804809 - protein, 222 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRFSDVGCFYETRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 804810 - protein, 189 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNQCQSKETH

SEQ ID NO: 804811 - protein, 189 aa, Homo sapiens; identical to SEQ ID NO: 804810

SEQ ID NO: 804812 - protein, 127 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRLTPTEIVLILPMPEQRNSLTAKATAVLLYHLFTSVAPP

SEQ ID NO: 804813 - protein, 211 aa, Homo sapiens; identical to SEQ ID NO: 804804

SEQ ID NO: 804814 - protein, 113 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPLQ

SEQ ID NO: 804815 - protein, 198 aa, Homo sapiens [sequence omitted]

SEQ ID NO: 804816 - protein, 198 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNRLYCPCRAKKLMAGKGS

SEQ ID NO: 804817 - protein, 126 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNSKQTDLGITEDALGKHAELKTILFQAKNFKAWTARYLH

SEQ ID NO: 804818 - protein, 248 aa, Homo sapiens
VPHLIPRSLQLPREVGSQPAAMSDINLDWVDRRQLQRLEEMLIVVDENDKVIGADTKRNCHLNENIEKGLLHRAFSVVLFNTKNRILIQQRSDTKVTFPGYFTDSCSSHPLYNPAELEEKDAIGVRRAAQRRLQAELGIPGEQISPEDIVFMTIYHHKAKSDRIWGEHEICYLLLVRKNVTLNPDPSETKSILYLSQEELWELLEREARGEVKVTPWLRTIAERFLYRWWPHLDDVTPFVELHKIHRV

SEQ ID NO: 804819 - protein, 248 aa, Homo sapiens; identical to SEQ ID NO: 804818

SEQ ID NO: 804820 - protein, 227 aa, Homo sapiens
MSDINLDWVDRRQLQRLEEMLIVVDENDKVIGADTKRNCHLNENIEKGLLHRAFSVVLFNTKNRILIQQRSDTKVTFPGYFTDSCSSHPLYNPAELEEKDAIGVRRAAQRRLQAELGIPGEQISPEDIVFMTIYHHKAKSDRIWGEHEICYLLLVRKNVTLNPDPSETKSILYLSQEELWELLEREARGEVKVTPWLRTIAERFLYRWWPHLDDVTPFVELHKIHRV

SEQ ID NO: 804821 - protein, 46 aa, Homo sapiens
LEEMLIVVDENDKVIGADTKRNCHLNENIEKGSPRPFSLSSSQGFP

SEQ ID NO: 804822 - protein, 387 aa, Homo sapiens
MKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLRRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVSLWAGLGGERGGECACLPDKAYPLLEVRMENVTVLGEDVIVNDELYLNGASVLPHKSIGESVPEPRIIM

SEQ ID NO: 804823 - protein, 400 aa, Homo sapiens
PEFGASSRLPGVAFCVVAALDPASGRPGGRGGARVCQAGAMKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLRRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 804824 - protein, 360 aa, Homo sapiens
MKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLRRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 804825 - protein, 360 aa, Homo sapiens; identical to SEQ ID NO: 804824

SEQ ID NO: 804826 - protein, 360 aa, Homo sapiens; identical to SEQ ID NO: 804824

SEQ ID NO: 804827 - protein, 360 aa, Homo sapiens; identical to SEQ ID NO: 804824

SEQ ID NO: 804828 - protein, 394 aa, Homo sapiens
GLSSGPAAVYPVSRSVLWRPWIRRQDTPSTSAGAMKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLRRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 804829 - protein, 462 aa, Homo sapiens
MKALILVGGYGTRLRPLTLSTPKPLVDFCNKPILLHQVEALAAAGVDHVILAVSYMSQVLEKEMKAQEQRVRHRLLALILGPRPTSHPGENLTGGASSFQLGIRISMSHEEEPLGTAGPLALARDLLSETADPFFVLNSDVICDFPFQAMVQFHRHHGQEGSILVRRQVFSLLTLSPSMPSLPCPLAFICLRMLWIQSCAVCIFKHLGQSLLRSGTACVSRLRNTGLGPRSPSLLQVTKVEEPSKYGVVVCEADTGRIHRFVEKPQVFVSNKINAGMYILSPAVLRRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 804830 - protein, 218 aa, Homo sapiens
MKRSLWGQLGPWRWPVTYSLRLQTLSSSSTAGMYILSPAVLRRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 804831 - protein, 198 aa, Homo sapiens
TPRGFPGKAPTTQALPSEPCSAAAHLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 804832 - protein, 132 aa, Homo sapiens
MMSSTSTEPACCPTSLLASQCQSLVSSCEGMQWGWPSPGFPISKGSAGLTHQKTLDLSLFVWGALGEAEAVGHLPSHVDIIWQDPCWAHPTNPTPSRRARARAVWNNNLMLTVALTESQAQAQLGPWLGSHQ

SEQ ID NO: 804833 - protein, 295 aa, Homo sapiens
MKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLRRIQLQPTSIEKEVFPIMAKEGQLYAMELQGFWMDIGQPKDFLTGMCLFLQSLRQKQPERLCSGPGIVGNVLVDPSARIGQNCSIGPNVSRNGNGSGHPAAPCTAGYTHHLR

SEQ ID NO: 804834 - protein, 132 aa, Homo sapiens; identical to SEQ ID NO: 804832

SEQ ID NO: 804835 - protein, 61 aa, Homo sapiens
LVDSRGSLGNTQRKLGEQSIPGGDREGRWSSRGTDRGENWCNTASQGWGDQSFTTEKTVKK

SEQ ID NO: 804836 - protein, 177 aa, Homo sapiens
LDRMVPISKQPKEKIQAIIESCSRQFPEFQERARKRIRTYLKSCRRMKKNGMEMTRPTPPHLTSAMAENILAAACESETRKAAKRMRLEIYQSSQDEPIALDKQHSRDSAAITHSTYSLPASSYSQDPVYANGGLNYSYRGYGALSSNLQPPASLQTGNHSNGPTDLSMKGGASTTS

SEQ ID NO: 804837 - protein, 100 aa, Homo sapiens
RTSAPKARSRAVSSGVRPPRSPAVYTGPAGSQSRSAPASVPDGASMPGSACSRRSQRSCSPSSSAYGTRPRRTSRTAGCRIVPTVASAGPRPLRGPGGVA

SEQ ID NO: 804838 - protein, 1432 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKFLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 804839 - protein, 1432 aa, Homo sapiens; identical to SEQ ID NO: 804838

SEQ ID NO: 804840 - protein, 1337 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKFLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSGERHGLALHP

SEQ ID NO: 804841 - protein, 177 aa, Homo sapiens
SVRRVLRYADSFDTLDSAHLGRISMSINMRDIVVIALLAILRTLIDILICCSCEPVSIVASTCLLSHILRLHVKLQAPPSITHKCCRWLASTLGRRFLQTSCTGKHLSLPNYCRLASTSPFRIAPGGMGWLIPNSSSWACCLLRATWKHTTMSHPPALQNQLCQNTEAPPIPDTMIH

SEQ ID NO: 804842 - protein, 230 aa, Homo sapiens
RQPAVRLVRLGRVPYAELLGLQDRWLRRLQAEPGIEAPSGTEAGALLLCEPAGPVYTAGLRGGLTPEETARLRALGAEVRVTGRGGLATFHGPGQLLCHPVLDLRRLGLRLRMHVASLEACAVRLCELQGLQDARARPPPYTGVWLDDRKICAIGVRCGRHITSHGLALNCSTDLTWFEHIVPCGLVGSGVTSLSKELQRHVTVEEVMPPFLVAFKEIYKCTLISEDSPN

SEQ ID NO: 804843 - protein, 206 aa, Homo sapiens
RQPAVRLVRLGRVPYAELLGLQDRWLRRLQAEPGIEAPSGTEAGALLLCEPAGPVYTAGLRGGLTPEETARLRALGAEVRVTGRGGLATFHGPGQLLCHPVLDLRRLGLRLRMHVASLEACAVRLCELQGLQDARARPPPYTGVWLDDRKICAIGERRGAGRYLRAEESAVEGTSHPTAWLSTALPTSRGLSTSCPVDWLGQASLP

SEQ ID NO: 804844 - protein, 170 aa, Homo sapiens
RQPAVRLVRLGRVPYAELLGLQDRWLRRLQAEPGIEAPSGTEAGALLLCEPAGPVYTAGLRGGLTPEETARLRALGAEVRVTGRGGLATFHGPGQLLCHPVLDLRRLGLRLRMHVASLEACAVRLCELQGLQDARARPPPYTGVWLDDRKICAIGERRGAGRYLRAEVGA

SEQ ID NO: 804845 - protein, 925 aa, Homo sapiens
MKGKERSPVKAKRSRGGEDSTSRGERSKKLGGSGGSNGSSSGKTDSGGGSRRSLLLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDGRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRAKLVEQRMKIWNSKL

SEQ ID NO: 804846 - protein, 933 aa, Homo sapiens
MKGKERSPVKAKRSRGGEDSTSRGERSKKLGGSGGSNGSSSGKTDSGGGSRRSLLLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDGRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRGFGFQIGVRYENKKRENLALTLL

SEQ ID NO: 804847 - protein, 913 aa, Homo sapiens
MKGKERSPVKAKRSRGGEDSTSRGERSKKLGGSGGSNGSSSGKTDSGGGSRRSLLLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDGRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRGAS

SEQ ID NO: 804848 - protein, 413 aa, Homo sapiens
MKGKERSPVKAKRSRGGEDSTSRGERSKKLGGSGGSNGSSSGKTDSGGGSRRSLLLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKQQPYSFL

SEQ ID NO: 804849 - protein, 925 aa, Homo sapiens; identical to SEQ ID NO: 804845

SEQ ID NO: 804850 - protein, 933 aa, Homo sapiens; identical to SEQ ID NO: 804846

SEQ ID NO: 804851 - protein, 933 aa, Homo sapiens; identical to SEQ ID NO: 804846

SEQ ID NO: 804852 - protein, 242 aa, Homo sapiens
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLIFGDWKCIWHCKTASQVHLMKFSPDGEFFATAGKDDCLLTVRYNVENWRTAVTSPDGSSEKQSQGDIDFSFVYLAHPRAVNGFSWRKT

SEQ ID NO: 804853 - protein, 242 aa, Homo sapiens; identical to SEQ ID NO: 804852

SEQ ID NO: 804854 - protein, 70 aa, Homo sapiens
GVGPAAQGKPRLSDPATGNGAPFGEEPQPGVGTHRLSDSSNTDRSSRAEGISFRRSHYSPRPLIATKPSC

SEQ ID NO: 804855 - protein, 297 aa, Homo sapiens
RRQDLEAQIRGLREEVEKGEGRLQTTHEELLLLRRERREHSLELERARSEAGEALSALRRLQRRVSELEEESRLQDADVSAASLQSELAHSLDDGDQGQGADAPGDTPTTRSPKTRKASSPQPSPPEEILEPPKKRTSLSPAEILEEKEVEVAKLQDEISLQQAELQSLREELQRQKELRAQEDPGEALHSALSDRDEAVNKALELSLQLNRVSLERDSLSRELLRAIRQKVALTQELEAWQDDMQVVIGQQLRSQRQKELSASASSSTPRRAAPRFSLRLGPGPAGGFLSNLFRRT

SEQ ID NO: 804856 - protein, 342 aa, Homo sapiens
QLLNEEVDWAGEEMGLFEVRPCSIGEETVYIRWGRCTAQGAQRSRNGNSLGRWGAGLSAAPPCGPAAGCRRCVRPADRPRFRLRDRPQLERARSEAGEALSALRRLQRRVSELEEESRLQDADVSAASLQSELAHSLDDGDQGQGADAPGDTPTTRSPKTRKASSPQPSPPEEILEPPKKRTSLSPAEILEEKEVEVAKLQDEISLQQAELQSLREELQRQKELRAQEDPGEALHSALSDRDEAVNKALELSLQLNRVSLERDSLSRELLRAIRQKVALTQELEAWQDDMQVVIGQQLRSQRQKELSASASSSTPRRAAPRFSLRLGPGPAGGFLSNLFRRT

SEQ ID NO: 804857 - protein, 140 aa, Homo sapiens
ELLQVGVDSPAAGTRHNSAGPAHLHRALSTASSMQRLPAATRATLILSLAFASLHSACSAEASSSNSSSLTAHHPDPGTLEQCLNVDFCPQAARCCRTGVDEYGWIAAAVGWSLWFLTLILLCVDKLMKLTPDEPKDLQA

SEQ ID NO: 804858 - protein, 586 aa, Homo sapiens
AAAEARPIAAPRSERLSACAIAPPWLVSSRPARPAQLQRPGKMVEDGAEELEDLVHFSVSELPSRGYGVMEEIRRQGKLCDVTLKIGDHKFSAHRIVLAASIPYFHAMFTNDMMECKQDEIVMQGMDPSALEALINFAYNGNLAIDQQNVQSLLMGASFLQLQSIKDACCTFLREGFTQKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEHYNHHTATWHPAAGMLNKRCRHGAASLGSKMFVCGGYDGSGFLSIAEMYSSVADQWCLIVPMHTRRSRVSLGGQLWAPLRCWGLRRTVKPKLSGDV

SEQ ID NO: 804859 - protein, 581 aa, Homo sapiens
MSRGSEKTIREWYFTGGPPWLVSSRPARPAQLQRPGKMVEDGAEELEDLVHFSVSELPSRGYGVMEEIRRQGKLCDVTLKIGDHKFSAHRIVLAASIPYFHAMFTNDMMECKQDEIVMQGMDPSALEALINFAYNGNLAIDQQNVQSLLMGASFLQLQSIKDACCTFLRERLHPKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEHYNHHTATWHPAAGMLNKRCRHGAASLGSKMFVCGGYDGSGFLSIAEMYSSVADQWCLIVPMHTRRSRVSLGGQLWAPLRCWGLRRTVKPKLSGDV

SEQ ID NO: 804860 - protein, 468 aa, Homo sapiens
MRLHDRYTVPSALEALINFAYNGNLAIDQQNVQSLLMGASFLQLQSIKDACCTFLRERLHPKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEHYNHHTATWHPAAGMLNKRCRHGAASLGSKMFVCGGYDGSGFLSIAEMYSSVADQWCLIVPMHTRRSRVSLGGQLWAPLRCWGLRRTVKPKLSGDV

SEQ ID NO: 804861 - protein, 319 aa, Homo sapiens
LGTRLGLNRRFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEHYNHHTATWHPAAGMLNKRCRHGAASLGSKMFVCGGYDGSGFLSIAEMYSSVADQWCLIVPMHTRRSRVSLGGQLWAPLRCWGLRRTVKPKLSGDV

SEQ ID NO: 804862 - protein, 109 aa, Homo sapiens
MELFSGPHEHRLHPGPAPTHRLSVGQLFTEGLPSDAPHRLLALQPSLANLPWGGCSVQACWKLGCSWGRKDRPKRSPCLRWCGHSSGRLHTGTFLLPQWGTKDSVLIAG

SEQ ID NO: 804863 - protein, 428 aa, Homo sapiens
AAAEARPIAAPRSERLSACAIAPPWLVSSRPARPAQLQRPGKMVEDGAEELEDLVHFSVSELPSRGYGVMEEIRRQGKLCDVTLKIGDHKFSAHRIVLAASIPYFHAMFTNDMMECKQDEIVMQGMDPSALEALINFAYNGNLAIDQQNVQSLLMGASFLQLQSIKDACCTFLREGFTQKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRRYSGSHVQPEHTH

SEQ ID NO: 804864 - protein, 637 aa, Homo sapiens
AAAEARPIAAPRSERLSACAIAPPWLVSSRPARPAQLQRPGKMVEDGAEELEDLVHFSVSELPSRGYGVMEEIRRQGKLCDVTLKIGDHKFSAHRIVLAASIPYFHAMFTNDMMECKQDEIVMQGMDPSALEALINFAYNGNLAIDQQNVQSLLMGASFLQLQSIKDACCTFLREGFTQKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEQLKQHTALEPEVGNCPKGLAETEPASLGEQECSALGGYKRTRVPPELRKCHVLGNPLCLLCPMVQAKETGIPGGTHERPKRRGGTKERTTHHHREPVAPRRNSGENKSTKQRTQKTTTGRNNPTKKKERRRASKDKTEQRTHTRKEA

SEQ ID NO: 804865 - protein, 187 aa, Homo sapiens
MEHAATTGPRPGPPSRRVENVVLRAKDWLPGAPGGTAVWATSLEAEVPPDLALNKEQQLQISKELVDIQITTHHLHEQHEAEIFQLKSEILRLESRVLELELRGDGTSQGCAVPVESDPRHPRAAAQELRHKAQVPGHSDDHRFQVQPKNTMNPENEQHRLGSGLQGEVKWALEHQEARQQALVTRV

SEQ ID NO: 804866 - protein, 252 aa, Homo sapiens
MEHAATTGPRPGPPSRRVENVVLRAKDWLPGAPGGTAVWATSLEAEVPPDLALNKEQQLQISKELVDIQITTHHLHEQHEAEIFQLKSEILRLESRVLELELRGDGTSQGCAVPVESDPRHPRAAAQELRHKAQVPGHSDDHRFQVQPKNTMNPENEQHRLGSGLQGEVKWALEHQEARQQALVTRVATLGRQLQGAREEARAAGQRLATQAVVLCSCQGQLRQAEAENARLQLQLKKLKDEYVLRLQHCAW

SEQ ID NO: 804867 - protein, 223 aa, Homo sapiens
AGGARARWGATRTLRPRRARRWHLLQEALPTPRLSQSFPSSPAPDGDVCAPLLRPEVVLRAKDWLPGAPGGTAVWATSLEAEVPPDLALNKEQQLQISKELVDIQITTHHLHEQHEAEIFQLKSEILRLESRVLELELRGDGTSQGCAVPVESDPRHPRAAAQELRHKAQVPGHSDDHRFQVQPKNTMNPENEQHRLGSGLQGEVKWALEHQEARQQALVTRV

SEQ ID NO: 804868 - protein, 119 aa, Homo sapiens
ENEQHRLGSGVSVQPPSSGERAAPETPSLGSHPASPVCPTAAGGSEVGAGASGGPAAGTGDACVSGHLTWGPILEQREPLIVGLLSLTPVSSGQPWAGSCREPERRPGQPGSDWPHRLW

SEQ ID NO: 804869 - protein, 501 aa, Homo sapiens
KRKSDRVGGSLSKLEDRQAAAATTAAAAEPSSDVEVETHRSPGLHLSYLSGHQEWQDKENPELGGTRMPDRDSYANGTGSSGGGPGGGGSEEASGAGVGSGGASSDAICRDFLRNVCKRGKRCRYRHPDMSEVSNLGVSKNEFIFCHDFQNKECSRPNCRFIHGSKEDEDGYKKTGELPPRLRQKVAAGLGLSPADLPNGKEEVPICRDFLKGDCQRGAKCKFRHLQRDFEFDARGGGGTGGGSTGSVLPGRRHDLYDIYDLPDRGFEDHEPGPKRRRGGCCPPDGPHFESYEYSLAPPRGVECRLLEEENAMLRKRVEELKKQVSNLLATNEVLLEQNAQFRNQAKVITLSSTAPATEQTLAPTVGTVATFNHGIAQTHTTLSSQALQPRPVSQQELVAPAGAPAAPPTNAAPPAAPPPPPPHLTPEITPLSAALAQTIAQGMAPPPVSMAPVAVSVAPVAPVAVSMAQPLAGITMSHTTTPMVTYPIASQSMRITAMPH

SEQ ID NO: 804870 - protein, 434 aa, Homo sapiens
MPDRDSYANGTGSSGGGPGGGGSEEASGAGVGSGGASSDAICRDFLRNVCKRGKRCRYRHPDMSEVSNLGVSKNEFIFCHDFQNKECSRPNCRFIHGSKEDEDGYKKTGELPPRLRQKVAAGLGLSPADLPNGKEEVPICRDFLKGDCQRGAKCKFRHLQRDFEFDARGGGGTGGGSTGSVLPGRRHDLYDIYDLPDRGFEDHEPGPKRRRGGCCPPDGPHFESYEYSLAPPRGVECRLLEEENAMLRKRVEELKKQVSNLLATNEVLLEQNAQFRNQAKVITLSSTAPATEQTLAPTVGTVATFNHGIAQTHTTLSSQALQPRPVSQQELVAPAGAPAAPPTNAAPPAAPPPPPPHLTPEITPLSAALAQTIAQGMAPPPVSMAPVAVSVAPVAPVAVSMAQPLAGITMSHTTTPMVTYPIASQSMRITAMPH

SEQ ID NO: 804871 - protein, 314 aa, Homo sapiens
KRKSDRVGGSLSKLEDRQAAAATTAAAAEPSSDVEVETHRSPGLHLSYLSGHQEWQDKENPELGGTRMPDRDSYANGTGSSGGGPGGGGSEEASGAGVGSGGASSDAICRDFLRNVAELLEEENAMLRKRVEELKKQVSNLLATNEVLLEQNAQFRNQAKVITLSSTAPATEQTLAPTVGTVATFNHGIAQTHTTLSSQALQPRPVSQQELVAPAGAPAAPPTNAAPPAAPPPPPPHLTPEITPLSAALAQTIAQGMAPPPVSMAPVAVSVAPVAPVAVSMAQPLAGITMSHTTTPMVTYPIASQSMRITAMPH

SEQ ID NO: 804872 - protein, 378 aa, Homo sapiens
KRKSDRVGGSLSKLEDRQAAAATTAAAAEPSSDVEVETHRSPGLHLSYLSGHQEWQDKENPELGGTRMPDRDSYANGTGSSGGGPGGGGSEEASGAGVGSGGASSDAICRDFLRNVCKRGKRCRYRHPDMSEVSNLGVSKNEFIFCHDFQNKECSRPNCRFIHGSKEDEDGYKKTGELPPRLRQKVAAGLGLSPADLPNGKEEVPICRDFLKGDCQRGAKCKFRHLQRDFEFDARGGGGTGGGSTGSVLPGRRHDLYDIYDLPDRGFEDHEPGPKRRRGGCCPPDGPHFESYEYSLAPPRGVECRLLEEENAMLRKRVEELKKQVSNLLATNEVLLEQNAQFRNQAKVITLSSTAPATEQTLAPTVGSIHLELVCQPR

SEQ ID NO: 804873 - protein, 2224 aa, Homo sapiens
MQPGSAPPPGRMDPSAPQPRAETSGKDIWHPGERCLAPSPDNGKLCEASIKSITVDENGKSFAVVLYADFQERKIPLKQLQEVKFVKDCPRNLIFDDEDLEKPYFPNRKFPSSSVAFKLSDNGDSIPYTINRYLRDYQREGTRFLYGHYIHGGGCILGDDMGLGKTVQVISFLAAVLHKKGTREDIENNMPEFLLRSMKKEPLSSTAKKMFLIVAPLSVLYNWKDELDTWGYFRVTVLHGNRKDNELIRVKQRKCEIALTTYETLRLCLDELNSLEWSAVIVDEAHRIKNPKARVTEVMKALKCNVRIGLTGTILQNNMKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVSSSKVYPGLASLNFGGIKNKAYAYMTPYSHIFSYYTVGNSELLDVLQQYCMASGLDYRRLDGSTKSEERLKIVKEFNSTQDVNICLVSTMAGGLGLNFVGANVVVLFDPTWNPANDLQAIDRTQTHCRRERDAEPLSSAPGLQNGSENAVPYPWWCCVTGASISCWRCEICRIQDVLEYKSIVRRDRAYRIGQCRDVKVLRLISLGTVEEIMYLRQIYKQQLHCVVVGSENAKRYFEAVQGSKEHQGELFGIHNLFKFRSQGSCLTKDILEVLNFFSDLFNNILNTVFLPQEICNTIAVAFSEKLLVFFIKNALEFLLLENEEMNYCTSKLKIFPCIITNNAHTQMYMLGSMNSKAILNRQREVYSFENSCRSQELKKEVFLNKQKYKMCFELKVTKYSLRCTLMSHGDFCFLFPIKIPHQYFKLSLLCSSSAYRCFLFLKQNILYPFLKKSLSSFIYRNTKDINHFLIDIHIGIIKSWSIIFFNLLMVEMRKLSLRELQDISLDFQDFVENLNVLHLFSKYHKGSSRSNWFLSLRNLNHLDLEVEENVYIITMQCQESYAEQVKQYDHGWLGERKREGQVEAGIMTATTWLKEGPPAHKLEMPRQPDCQECRGTEQAAEPLAKEACDLCSDFSDEEPVGATGIKTAKNKAPDSSKASSSPGQLTLLQCGFSKLLETKCKAVEDSDGNTASDDESSDEQPTCLSTEAKDAGCEKNQDSLGTSKHQKLDNILNPKEKHIFYKSEKILEQNISSKSDEKKIKNTDKHCILQNVTESEDSDVICPTQYTTERFPDNSIRFKPPLEGSEDSETEHTVKTRNNDNSRNTDDKRNGIISKKLSPENTTLKSILKRKGTSDISDESDDIEISSKSRVRKRASSLRFKRIKETKKELHNSPKTMNKTNQVYAANEDHNSQFIDDYSSSDESLSVSHFSFSKQSHRPRTIRDRTSFSSKLPSHNKKNSTFIPRKPMKCSNEKVVNQEQSYESMDKFLDGVQEVAYIHSNQNVIGSSKAENHMSRWAAHDVFELKQFSQLPANIAVCSSKKTFEEMASYFNSSSVNEFAKHITNATSEERQKMLRDFYASQYPEVKEFFVDSVSQFNNSSFEKGEQRTRKKSDKRESLIKPRLSDSETLSFKDSTNKISQVCSLKTYKRKSVKFQNHISYREEVFFNDAETKKSPVSSTQEIDSGKNSQASEDTVTSRSLNSESETRERRLENTMKDQQDLTRTGISRKEPLLKLENKKIENPVLENTSVISLLGDTSILDDLFKSHGNSPTQLPKKVLSGPMEKAKQRPKDFWDILNEQNDESLSKLTDLAVIETLCEKAPLQHPLKGEKSQQLLFGNQMRNFYGRNLAQVIQMKTQPIHRVPHKHINELLHQKTAAITVYGTGFHTDSIILNTVVDIYFYEIIALGFFEVYKYCHGSVFLDIDLIFQEYDCIYSINLCYELEKILGLLIGDLGIFLTILHNDVTLAPVSMFPSMKDEESVPNQHECPSSLKKLCFALLMAHRLNHVCPSNQVYTNVFFTSTGKVIKYFLFPWASCSIIILEKSHNWYCIYGIYNIKMVILQQLKIKRLMLYTLLYELVITTISHRYQCLNFLCTYCDFNVNKGLYSTFVVLKYEEMGKLFILLETVDILSVIFMVYSKMNVLIVECMYLEAFTPAPVFCARSLSSTGKAELPVNEEEIMSVKNHGGKPLASHVHAVGRT

SEQ ID NO: 804874 - protein, 2266 aa, Homo sapiens
MQPGSAPPPGRMDPSAPQPRAETSGKDIWHPGERCLAPSPDNGKLCEASIKSITVDENGKSFAVVLYADFQERKIPLKQLQEVKFVKDCPRNLIFDDEDLEKPYFPNRKFPSSSVAFKLSDNGDSIPYTINRYLRDYQREGTRFLYGHYIHGGGCILGDDMGLGKTVQVISFLAAVLHKKGTREDIENNMPEFLLRSMKKEPLSSTAKKMFLIVAPLSVLYNWKDELDTWGYFRVTVLHGNRKDNELIRVKQRKCEIALTTYETLRLCLDELNSLEWSAVIVDEAHRIKNPKARVTEVMKALKCNVRIGLTGTILQNNMKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVSSSKVYPGLASLNFGGIKNKAYAYMTPYSHIFSYYTVGNSELLDVLQQYCMASGLDYRRLDGSTKSEERLKIVKEFNSTQDVNICLVSTMAGGLGLNFVGANVVVLFDPTWNPANDLQAIDRTQTHCRRERDAEPLSSAPGLQNGSENAVPYPWWCCVTGASISCWRCEICRIQDVLEYKSIVRRDRAYRIGQCRDVKVLRLISLGTVEEIMYLRQIYKQQLHCVVVGSENAKRYFEAVQGSKEHQGELFGIHNLFKFRSQGSCLTKDILEVLNFFSDLFNNILNTVFLPQEICNTIAVAFSEKLLVFFIKNALEFLLLENEEMNYCTSKLKIFPCIITNNAHTQMYMLGSMNSKAILNRQREVYSFENSCRSQELKKEVFLNKQKYKMCFELKVTKYSLRCTLMSHGDFCFLFPIKIPHQYFKLSLLCSSSAYRCFLFLKQNILYPFLKKSLSSFIYRNTKDINHFLIDIHIGIIKSWSIIFFNLLMVEMRKLSLRELQDISLDFQDFVENLNVLHLFSKYHKGSSRSNWFLSLRNLNHLDLEVEENVYIITMQCQESYAEQVKQYDHGWLGERKREGQVEAGIMTATTWLKEGPPAHKLEMPRQPDCQECRGTEQAAEPLAKEACDLCSDFSDEEPVGATGIKTAKNKAPDSSKASSSPGQLTLLQCGFSKLLETKCKAVEDSDGNTASDDESSDEQPTCLSTEAKDAGCEKNQDSLGTSKHQKLDNILNPKEKHIFYKSEKILEQNISSKSDEKKIKNTDKHCILQNVTESEDSDVICPTQYTTERFPDNSIRFKPPLEGSEDSETEHTVKTRNNDNSRNTDDKRNGIISKKLSPENTTLKSILKRKGTSDISDESDDIEISSKSRVRKRASSLRFKRIKETKKELHNSPKTMNKTNQVYAANEDHNSQFIDDYSSSDESLSVSHFSFSKQSHRPRTIRDRTSFSSKLPSHNKKNSTFIPRKPMKCSNEKVVNQEQSYESMDKFLDGVQEVAYIHSNQNVIGSSKAENHMSRWAAHDVFELKQFSQLPANIAVCSSKTYKEKVDADTLPHTKKGQQPSEGSISLPLYISNPVNQKKKKVYHTNQTTFIIGETPKGIRRKQFEEMASYFNSSSVNEFAKHITNATSEERQKMLRDFYASQYPEVKEFFVDSVSQFNNSSFEKGEQRTRKKSDKRESLIKPRLSDSETLSFKDSTNKISQVCSLKTYKRKSVKFQNHISYREEVFFNDAETKKSPVSSTQEIDSGKNSQASEDTVTSRSLNSESETRERRLENTMKDQQDLTRTGISRKEPLLKLENKKIENPVLENTSVISLLGDTSILDDLFKSHGNSPTQLPKKVLSGPMEKAKQRPKDFWDILNEQNDESLSKLTDLAVIETLCEKAPLQHPLKGEKSQQLLFGNQMRNFYGRNLAQVIQMKTQPIHRVPHKHINELLHQYTAAITVYGTGFHTDSIILNTVVDIYFYEIIALGFFEVYKYCHGSVFLDIDLIFQEYDCIYSINLCYELEKILGLLIGDLGIFLTILHNDVTLAPVSMFPSMKDEESVPNQHECPSSLKKLCFALLMAHRLNHVCPSNQVYTNVFFTSTGKVIKYFLFPWASCSIIILEKSHNWYCIYGIYNIKMVILQQLKIKRLMLYTLLYELVITTISHRYQCLNFLCTYCDFNVNKGLYSTFVVLKYEEMGKLFILLETVDILSVIFMVYSKMNVLIVECMYLEAFTAAPVFCARSLSSTGKAELPVNERKSCQ

SEQ ID NO: 804875 - protein, 530 aa, Homo sapiens
MQPGSAPPPGRMDPSAPQPRAETSGKDIWHPGERCLAPSPDNGKLCEASIKSITVDENGKSFAVVLYADFQERKIPLKQLQEVKFVKDCPRNLIFDDEDLEKPYFPNRKFPSSSVAFKLSDNGDSIPYTINRYLRDYQREGTRFLYGHYIHGGGCILGDDMGLGKTVQVISFLAAVLHKKGTREDIENNMPEFLLRSMKKEPLSSTAKKMFLIVAPLSVLYNWKDELDTWGYFRVTVLHGNRKDNELIRVKQRKCEIALTTYETLRLCLDELNSLEWSAVIVDEAHRIKNPKARVTEVMKALKCNVRIGLTGTILQNNMKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVSSSKVYP

SEQ ID NO: 804876 - protein, 683 aa, Homo sapiens
MQPGSAPPPGRMDPSAPQPRAETSGKDIWHPGERCLAPSPDNGKLCEASIKSITVDENGKSFAVVLYADFQERKIPLKQLQEVKFVKDCPRNLIFDDEDLEKPYFPNRKFPSSSVAFKLSDNGDSIPYTINRYLRDYQREGTRFLYGHYIHGGGCILGDDMGLGKTVQVISFLAAVLHKKGTREDIENNMPEFLLRSMKKEPLSSTAKKMFLIVAPLSVLYNWKDELDTWGYFRVTVLHGNRKDNELIRVKQRKCEIALTTYETLRLCLDELNSLEWSAVIVDEAHRIKNPKARVTEVMKALKCNVRIGLTGTILQNNMKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVLQQLLNHCRKNRDKVLLFSFSTKLLDVLQQYCMASGLDYRRLDGSTKSEERLKIVKEFNSTQDVNICLVSTMAGGLGLNFVGANVVVLFDPTWNPANDLQAIDRTQTHCRRERDAEPLSSAPGLQNGSENAVPYPWWCCVTGASISCWRCEICRIQDVLE

SEQ ID NO: 804877 - protein, 530 aa, Homo sapiens; identical to SEQ ID NO: 804875

SEQ ID NO: 804878 - protein, 602 aa, Homo sapiens
MQPGSAPPPGRMDPSAPQPRAETSGKDIWHPGERCLAPSPDNGKLCEASIKSITVDENGKSFAVVLYADFQERKIPLKQLQEVKFVKDCPRNLIFDDEDLEKPYFPNRKFPSSSVAFKLSDNGDSIPYTINRYLRDYQREGTRFLYGHYIHGGGCILGDDMGLGKTVQVISFLAAVLHKKGTREDIENNMPEFLLRSMKKEPLSSTAKKMFLIVAPLSVLYNWKDELDTWGYFRVTVLHGNRKDNELIRVKQRKCEIALTTYETLRLCLDELNSLEWSAVIVDEAHRIKNPKARVTEVMKALKCNVRIGLTGTILQNNMKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVLQQLLNHCRKNRDKVLLFSFSTKLLDVLQQYCMASGLDYRRLDGSTKSEERLKIVKEFNSTQDVNICLVSTIRDGVSPF

SEQ ID NO: 804879 - protein, 957 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGRVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 804880 - protein, 957 aa, Homo sapiens; identical to SEQ ID NO: 804879

SEQ ID NO: 804881 - protein, 957 aa, Homo sapiens; identical to SEQ ID NO: 804879

SEQ ID NO: 804882 - protein, 878 aa, Homo sapiens
ADICASNQRDSVGVEPSEPGVGYNLVVRRFLSQSEKRSIRVGVTRFSSESVTPFFDSERELPDPLRFPSEAMPRPASARARCAHPLTCAHCLALPSEMNPVPQMEMQKSPVFCVVTLGAVDQSCFLFGNLGSSTERSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 804883 - protein, 416 aa, Homo sapiens
MGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 804884 - protein, 867 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGRVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKKHGLELDTTQLGLSSQQIYTQ

SEQ ID NO: 804885 - protein, 932 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGRVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMEKFLKYSQGGQEKTWDQCGDVETY

SEQ ID NO: 804886 - protein, 50 aa, Homo sapiens
VALNLTKYLKREENFLPWQRVISAVTYIISMFEDDKELYPMIEVTLMLWY

SEQ ID NO: 804887 - protein, 968 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGRVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFCKYCSRPHRTPFEMGFNYLGMVKDSMVRVIWESMVSFEEIGGLIPGPCRGFKPVRF

SEQ ID NO: 804888 - protein, 604 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGRVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEVN

SEQ ID NO: 804889 - protein, 538 aa, Homo sapiens
AERALGGGSGRAEGGGFGVGAQGRAGGRRVEAGRMRLSKTLVDMDMADYSAALDPAYTTLEFENVQVLTMGNDFVAAASRQIEASPPTSLEHSGGVDSSPQGDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 804890 - protein, 451 aa, Homo sapiens
AERALGGGSGRAEGGGFGVGAQGRAGGRRVEAGRMRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGPCQAQEGRGWSGDSPGDRPHTVSSPLSSLASPLCRFGQVA

SEQ ID NO: 804891 - protein, 83 aa, Homo sapiens
PSSVLRGGSCVFSIQPSKALPRFSRQCVVDKDKRNQCRYCRLKKCFRAGMKKEGEPRPSPPHHHCPTCTHSSPTVIYNCSHTL

SEQ ID NO: 804892 - protein, 508 aa, Homo sapiens
AERALGGGSGRAEGGGFGVGAQGRAGGRRVEAGRMRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 804893 - protein, 498 aa, Homo sapiens
AERALGGGSGRAEGGGFGVGAQGRAGGRRVEAGRMRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMSTPETPQPSPPGGSGSEPYKLLPGAVATIVKPLSAIPQPTITKQEVI

SEQ ID NO: 804894 - protein, 161 aa, Homo sapiens [sequence omitted]

SEQ ID NO: 804895 - protein, 347 aa, Homo sapiens
MEQYTANSNSSTEQIVVQAGQIQQQQQGGVTAVQLQTEAQVASASGQQVQTLQVVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQDPNQADEEAMTQIIRVS

SEQ ID NO: 804896 - protein, 318 aa, Homo sapiens
MEQYTANSNSSTEQIVVQAGQIQQQVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQDPNQADEEAMTQIIRVS

SEQ ID NO: 804897 - protein, 347 aa, Homo sapiens; identical to SEQ ID NO: 804895

SEQ ID NO: 804898 - protein, 318 aa, Homo sapiens; identical to SEQ ID NO: 804896

SEQ ID NO: 804899 - protein, 203 aa, Homo sapiens
MLSYRSVDIRKSLQLEELLAREQLEYTIEEEVAKQTIRMWLKKCLKRIRAKQQQSCSIIHSLRESQQQELSRFLNPPSIETTQPSEDTNANSQDNSMQPETSSQQQLLSPTLSDRGGSRQDAADAGKPQRKFGQWRLPSAPKPISHSVSSVNLRFGGRTTMKSVVCKMNPMTDAASCGSEVKKWWTRQLTVESDESGDDLLDI

SEQ ID NO: 804900 - protein, 213 aa, Homo sapiens
MLSYRSVDIRKSLQLEELLAREQLEYTIEEEVAKQTIRMWLKKCLKRIRAKQQQSCSIIHSLRESQQQELSRFLNPPSIETTQPSEDTNANSQDNSMQPETSSQQQLLSPTLSDRGGSRQDAADAGKPQRKFGQWRLPSAPKPISHSVSSVNLRFGGRTTMKSVVCKMNPMTDAASCGSEVKKWWTRQLTVESDLVGGTRFLMKALNGPGAIV

SEQ ID NO: 804901 - protein, 170 aa, Homo sapiens
MLSYRSVDIRKSLQLEELLAREQLEYTIEEEVAKQTIRMWLKKCLKRIRAKQQQSCSIIHSLRESQQQELSRFLNPPSIETTQPSEDTNANSQDNSMQPETSSQQQLLSPTLSDRGGSRQDAADAGKPQRKFGQWRLPSAPKPISHSVSSVNLRFGGRTTMKSVVGGPGS

SEQ ID NO: 804902 - protein, 242 aa, Homo sapiens
MGDAGAVRSSRGDQELRRLQSDCRAHRRDEDQLGTAAALASAVRDGELWRLPLFGPISILLSTCCMLSVLLRASTWMEAVCSGWTGGECILCRRDNQVLRPEVITRPGALRQGLVARPEEQSSGCAQNSEVRPLNSDRTFQPIGNEAAQAARGLVKSEVCRDGAVILCFLWQSQHQPRCTLLLASLGSPALRVVAASCKYPTLRFCNIHFCSLSLAKPAQSVPNLYPLCLKYLVWFLFPDLT

SEQ ID NO: 804903 - protein, 242 aa, Homo sapiens; identical to SEQ ID NO: 804902

SEQ ID NO: 804904 - protein, 242 aa, Homo sapiens; identical to SEQ ID NO: 804902

SEQ ID NO: 804905 - protein, 242 aa, Homo sapiens; identical to SEQ ID NO: 804902

SEQ ID NO: 804906 - protein, 641 aa, Homo sapiens
PDARWPDGRKDYIRLTRPGLTLPGRAMFARGSRRRRSGRAPPEAEDPDRGQPCNSCREQCPGFLLHGWRKICQHCKCPREEHAVHAVPVDLERIMCRLISDFQRHSISDDDSGCASEEYAWVPPGLKPEQVYQFFSCLPEDKVPYVNSPGEKYRIKQLLHQLPPHDSEAQYCTALEEEEKKELRAFSQQRKRENLGRGIVRIFPVTITGAICEECGKQIGGGDIAVFASRAGLGACWHPQCFVCTTCQELLVDLIYFYHVGKVYCGRHHAECLRPRCQACDEIIFSPECTEAEGRHWHMDHFCCFECEASLGGQRYVMRQSRPHCCACYEARHAEYCDGCGEHIGLDQGQMAYEGQHWHASDRCFCCSRCGRALLGRPFLPRRGLIFCSRACSLGSEPTAPGPSRRSWSAGPVTAPLAASTASFSAVKGASETTTKGTSTELAPATGPEEPSRFLRGAPHRHSMPELGLRSVPEPPPESPGQPNLRPDDSAFGRQSTPRVSFRDPLVSEGGPRRTLSAPPAQRRRPRSPPPRAPSRRRHHHHNHHHHHNRHPSRRRHYQCDAGSGSDSESCSSSPSSSSSESSEDDGFFLGERIPLPPHLCRPMPAQDTAMETFNSPSLSLPRDSRAGMPRQARDKNCIVA

SEQ ID NO: 804907 - protein, 641 aa, Homo sapiens; identical to SEQ ID NO: 804906

SEQ ID NO: 804908 - protein, 131 aa, Homo sapiens
MPTPLWERAPWERKGGVRERFTSQSPGENQNLFPAFSKRAPFWRREEGTQGCPASDSPPLLEKGLVHEGWGYAWGFCLSFSPSSFPTGLDQGQMAYEGQHWHASDRCFCCSRCGRALLGRPFLPRRGLIFC

SEQ ID NO: 804909 - protein, 105 aa, Homo sapiens
LDLTGSFTAKGPPPRILRSLAPTWRTGGFRCPRRKLRPADRRYLTWDLLSDRGPNAARDQKKSRGPNAARDQKESRSFAIYRSLRAEGRTVGTISQGDFHFLPYM

SEQ ID NO: 804910 - protein, 105 aa, Homo sapiens; identical to SEQ ID NO: 804909

SEQ ID NO: 804911 - protein, 105 aa, Homo sapiens; identical to SEQ ID NO: 804909

SEQ ID NO: 804912 - protein, 105 aa, Homo sapiens; identical to SEQ ID NO: 804909

SEQ ID NO: 804913 - protein, 42 aa, Homo sapiens
MQRKPGKQADTGWFVEQHSPSSLRPSLLTSADLFQNKQTLKP

SEQ ID NO: 804914 - protein, 118 aa, Homo sapiens
PRVRGRVGPLAPRRSPTPFFMASLLCCGPKLAACGIVLSAWGVIMLIMLGIFFNVHSAVLIEDVPFTEKDFENGPQNIYNLYEQVSYNCFIAAGLYLLLGGFSFCQVRLNKRKEYMVR

SEQ ID NO: 804915 - protein, 71 aa, Homo sapiens
RIQASNDVRGHGALGPRRVSPLQPLLYLKTPCTVSPRSRPTLAGALCGTGFPGRETESLLPSLASGPRGEG

SEQ ID NO: 804916 - protein, 71 aa, Homo sapiens; identical to SEQ ID NO: 804915

SEQ ID NO: 804917 - protein, 85 aa, Homo sapiens
LHPRRPLYLKTPCTVSHRGRRQGWDATWVTRCRESLNRGGAGAGKRAGALAHHVFLAGALCGTGFPGRETESLLPSLASGPRGEG

SEQ ID NO: 804918 - protein, 78 aa, Homo sapiens
QANLANKDSAGSTSTTTLPTTFRVVGVQLQDQQVVIHYSIVKRLKDNQATPTFPQWGKARQVYGFNFASKEEATTFSC

SEQ ID NO: 804919 - protein, 192 aa, Homo sapiens
MTSASTKVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQDSLTLDSGLLMTSADPPLLSC

SEQ ID NO: 804920 - protein, 137 aa, Homo sapiens
IRGRVDTAGEDDRRGRASWAFSHRFPSPLAPRRSPTPFFMASLLCCGPKLAACGIVLSAWGVIMLIMLGIFFNVHSAVLIEDVPFTEKDFENGPQNIYNLYEQVSYNCFIAAGLYLLLGGFSFCQVRLNKRKEYMVR

SEQ ID NO: 804921 - protein, 192 aa, Homo sapiens; identical to SEQ ID NO: 804919

SEQ ID NO: 804922 - protein, 253 aa, Homo sapiens
MTSASTKVRPPSRTALPGGHGRAGPPLGSRLFRPGRGAGGSRAWGGARGSGRDGEGGRRPPVTLPRPQVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQDSLTLDSGLLMTSADPPLLSC

SEQ ID NO: 804923 - protein, 192 aa, Homo sapiens; identical to SEQ ID NO: 804919

SEQ ID NO: 804924 - protein, 137 aa, Homo sapiens; identical to SEQ ID NO: 804920

SEQ ID NO: 804925 - protein, 192 aa, Homo sapiens; identical to SEQ ID NO: 804919

SEQ ID NO: 804926 - protein, 192 aa, Homo sapiens; identical to SEQ ID NO: 804919

SEQ ID NO: 804927 - protein, 192 aa, Homo sapiens; identical to SEQ ID NO: 804919

SEQ ID NO: 804928 - protein, 166 aa, Homo sapiens
MQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQDSLTLDSGLLMTSADPPLLSC

SEQ ID NO: 804929 - protein, 137 aa, Homo sapiens; identical to SEQ ID NO: 804920

SEQ ID NO: 804930 - protein, 225 aa, Homo sapiens
MTSASTKVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQDQGRSPPPPTQLTGLGRKGSPGWQGTVSAGAPPLYRGFRREGALIHSAGHWIST

SEQ ID NO: 804931 - protein, 157 aa, Homo sapiens
MTSASTKVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADSLTLDSGLLMTSADPPLLSC

SEQ ID NO: 804932 - protein, 77 aa, Homo sapiens
NSRPRRHGWRRRQKGEGILGFLPPLSEPACTSAIPDSLLYGVAPVLWAEAGRLRHRPQRLGSDHVVIHPPPLQEEMI

SEQ ID NO: 804933 - protein, 157 aa, Homo sapiens
MTSASTKVRPPSRTALPGGHGRAGPPLGSRLFRPGRGAGGSRAWGGARGSGRDGEGGRRPPVTLPRPQVGEIFSAAGAAFTKLGELTMQLHPVADSSPAGAKWTETEIEMLRAAVKRFGDDLNHISCVIKERTVAQIKATVKRKCDTQCSERLRCQQ

SEQ ID NO: 804934 - protein, 137 aa, Homo sapiens; identical to SEQ ID NO: 804920

SEQ ID NO: 804935 - protein, 137 aa, Homo sapiens; identical to SEQ ID NO: 804920

SEQ ID NO: 804936 - protein, 137 aa, Homo sapiens; identical to SEQ ID NO: 804920

SEQ ID NO: 804937 - protein, 137 aa, Homo sapiens; identical to SEQ ID NO: 804920

SEQ ID NO: 804938 - protein, 137 aa, Homo sapiens; identical to SEQ ID NO: 804920

SEQ ID NO: 804939 - protein, 192 aa, Homo sapiens; identical to SEQ ID NO: 804919

SEQ ID NO: 804940 - protein, 192 aa, Homo sapiens; identical to SEQ ID NO: 804919

SEQ ID NO: 804941 - protein, 192 aa, Homo sapiens; identical to SEQ ID NO: 804919

SEQ ID NO: 804942 - protein, 157 aa, Homo sapiens; identical to SEQ ID NO: 804931

SEQ ID NO: 804943 - protein, 137 aa, Homo sapiens; identical to SEQ ID NO: 804920

SEQ ID NO: 804944 - protein, 103 aa, Homo sapiens
PRVRGRVGPLAPRRSPTPFFMASLLCCGPKLAACGIVLSAWGVIMLVRGLPGKDRRGPEGLRAGRAGRRGNSGPQAGRRGRGSTGPGEGDRLKLKNGNCSRPA

SEQ ID NO: 804945 - protein, 152 aa, Homo sapiens
MTSASTKVRPPSRTALPGGHGRAGPPLGSRLFRPGRGAGGSRAWGGARGSGRDGEGGRRPPVTLPRPQVGEIFSAAGAAFTKLGELTMQLHPVADSSPAGAKWTETEIEMLRAAVKRFGDDLNHISCVIKERTVAQIKATVKRKVTWWILKG

SEQ ID NO: 804946 - protein, 137 aa, Homo sapiens; identical to SEQ ID NO: 804920

SEQ ID NO: 804947 - protein, 137 aa, Homo sapiens; identical to SEQ ID NO: 804920

SEQ ID NO: 804948 - protein, 137 aa, Homo sapiens; identical to SEQ ID NO: 804920

SEQ ID NO: 804949 - protein, 83 aa, Homo sapiens
RAWGGARGSGRDGEGGRRPPVTLPRPQVGEIFSAAGAAFTKLGELTMQLHPVADSSPAGYVSPDWDVDAESGRLDSVTDTDPL

SEQ ID NO: 804950 - protein, 124 aa, Homo sapiens
QSQQAHFTGTKLWADPTDLKRQLKKVGCDRCPWPRQWSTQASSSMLGKGKPPILVMEVAMTMSGFQRQLCKNRNQQLPNIWPYLLCKPQGPGPFRGASGILWNQLLSGISDAIPGQLPLLCAIL

SEQ ID NO: 804951 - protein, 209 aa, Homo sapiens
STHGVGACAPRRSAGWQSQRSLRVRAGPDFVRGPGGGGGRGVRGRLSPPRWALPGAPPWAAASARAAMSYMLPHLHNGWQVDQAILSEEDRVVVIRFGHDWDPTCMKMDEVLYSIAEKVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 804952 - protein, 209 aa, Homo sapiens; identical to SEQ ID NO: 804951

SEQ ID NO: 804953 - protein, 209 aa, Homo sapiens; identical to SEQ ID NO: 804951

SEQ ID NO: 804954 - protein, 209 aa, Homo sapiens; identical to SEQ ID NO: 804951

SEQ ID NO: 804955 - protein, 103 aa, Homo sapiens
MAENVKGFVCVNVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 804956 - protein, 103 aa, Homo sapiens
MLLARKQILCVNVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 804957 - protein, 103 aa, Homo sapiens; identical to SEQ ID NO: 804956

SEQ ID NO: 804958 - protein, 119 aa, Homo sapiens
RLKREGQREVGDDQSERAACRRGEDKRQVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 804959 - protein, 104 aa, Homo sapiens
YGVTDSLTNQRYQVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 804960 - protein, 119 aa, Homo sapiens; identical to SEQ ID NO: 804958

SEQ ID NO: 804961 - protein, 124 aa, Homo sapiens
STHGVGACAPRRSAGWQSQRSLRVRAGPDFVRGPGGGGGRGVRGRLSPPRWALPGAPPWAAASARAAMSYMLPHLHNGWQVDQAILSEEDRVVVIRFGHDWDPTCMKMDEVLYSIAEKEQAHHD

SEQ ID NO: 804962 - protein, 209 aa, Homo sapiens; identical to SEQ ID NO: 804951

SEQ ID NO: 804963 - protein, 209 aa, Homo sapiens; identical to SEQ ID NO: 804951

SEQ ID NO: 804964 - protein, 143 aa, Homo sapiens
LEDPVQAALHNGWQVDQAILSEEDRVVVIRFGHDWDPTCMKMDEVLYSIAEKVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 804965 - protein, 134 aa, Homo sapiens
PTTTTKFAAASTEEDRVVVIRFGHDWDPTCMKMDEVLYSIAEKVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 804966 - protein, 103 aa, Homo sapiens; identical to SEQ ID NO: 804956

SEQ ID NO: 804967 - protein, 107 aa, Homo sapiens
RSRYLNIRVLYSIAEKVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 804968 - protein, 209 aa, Homo sapiens; identical to SEQ ID NO: 804951

SEQ ID NO: 804969 - protein, 121 aa, Homo sapiens
STHGVGACAPRRSAGWQSQRSLRVRAGPDFVRGPGGGGGRGVRGRLSPPRWALPGAPPWAAASARAAMSYMLPHLHNGWQVDQAILSEEDRVVVIRFGHDWDPTCMKMDEVLYSIAEKVVA

SEQ ID NO: 804970 - protein, 96 aa, Homo sapiens
AFFSDVNKSLSQWEKYGIVFKEFFFKETSMRMDALVSRCRNKHIMIDLGTGNNNKINWAMEDKQEMVDIIETVYRGARKGRGLVVSPKDYSTKYRY

SEQ ID NO: 804971 - protein, 121 aa, Homo sapiens; identical to SEQ ID NO: 804969

SEQ ID NO: 804972 - protein, 209 aa, Homo sapiens; identical to SEQ ID NO: 804951

SEQ ID NO: 804973 - protein, 103 aa, Homo sapiens; identical to SEQ ID NO: 804956

SEQ ID NO: 804974 - protein, 119 aa, Homo sapiens; identical to SEQ ID NO: 804958

SEQ ID NO: 804975 - protein, 158 aa, Homo sapiens
STHGVGACAPRRSAGWQSQRSLRVRAGPDFVRGPGGGGGRGVRGRLSPPRWALPGAPPWAAASARAAMSYMLPHLHNGWQVDQAILSEEDRVVVIRFGHDWDPTCMKMDEVLYSIAEKVKNFAVIYLVDITEVPDFNKMYELYDPCTVMFFFSYHRGW

SEQ ID NO: 804976 - protein, 124 aa, Homo sapiens; identical to SEQ ID NO: 804961

SEQ ID NO: 804977 - protein, 103 aa, Homo sapiens; identical to SEQ ID NO: 804956

SEQ ID NO: 804978 - protein, 162 aa, Homo sapiens
AAAAEVGPRAGDGPAPGSQGTSVRSSCCQAEGGPGQAQVWSYLQPTGPSSGGPPLGTSYGKRVTDLVLLCVSAASVGPLRETAGGSSSSLSAEPAFSSLLLKSGPGRVRAYRPCLRSPGLQELRAAPARWRGRGRFSGRLAWTRTGLWKLPALTGLPVTTAK

SEQ ID NO: 804979 - protein, 224 aa, Homo sapiens
RDPPGPVSGSGGQASGHTGTRGQLDTVGRGCPMDGVCLSGQQGRRVGVSEIIRGLCCPPLGGAEAGPDTLLEGTFFSLCVQGTSVRSSCCQAEGGPGQAQVWSYLQPTGPSSGGPPLGTSYGKRVTDLVLLCVSAASVGPLRETAGGSSSSLSAEPAFSSLLLKSGPGRVRAYRPCLRSPGLQELRAAPARWRGRGRFSGRLAWTRTGLWKLPALTGLPVTTAK

SEQ ID NO: 804980 - protein, 169 aa, Homo sapiens
AAAAEVGPRAGDGPAPGSQVTREGSQGTSVRSSCCQAEGGPGQAQVWSYLQPTGPSSGGPPLGTSYGKRVTDLVLLCVSAASVGPLRETAGGSSSSLSAEPAFSSLLLKSGPGRVRAYRPCLRSPGLQELRAAPARWRGRGRFSGRLAWTRTGLWKLPALTGLPVTTAK

SEQ ID NO: 804981 - protein, 162 aa, Homo sapiens; identical to SEQ ID NO: 804978

SEQ ID NO: 804982 - protein, 162 aa, Homo sapiens; identical to SEQ ID NO: 804978

SEQ ID NO: 804983 - protein, 98 aa, Homo sapiens
TISYIACCLSRTRTCTLIKGRSLRRVVEMSDSDPRCCLSRERNKLSTSASPRGPRPEPHAQDSPTAVPPLPADSNSSESAHSGLQGKCLGWFPAPRWR

SEQ ID NO: 804984 - protein, 127 aa, Homo sapiens
MAFPINDIVIFYALVFSLHCINVVAIKFWLRTRSVCGPRTYSKGALLGNAHPVGAGDPEGKDAALEPSACLPGHLCCLTLRRLHSEAFKIIIKKRKILQDTAPTLSAQSSPTRSIPKPFAGLARLVF

SEQ ID NO: 804985 - protein, 117 aa, Homo sapiens
MQRRGQPLENHVALIHWQSAGIPASKVHNYCNMKKSRLGRSRAVRISQPLLSPRRCPLHLTERGAGLLQPQPQGPVRTPGPPSGSHPSGRGQLNKHPKALRSVKGGDSHTARGARRP

SEQ ID NO: 804986 - protein, 146 aa, Homo sapiens
MKKSRLGRSRAVRISQPLLSPRRCPLHLTERGAGLLQPQPQGPVRTPGPPSGSHPAAADNWINTPKRCGRSRAGTATLRAGPAGRNKEWLDLAAACRGRGTSFRLAPLPGARAPSPTRKTAQQLFLPSPPTPTLRNLPTRGCRASV

SEQ ID NO: 804987 - protein, 105 aa, Homo sapiens
MDRRKGEPSKCENSSLLCHLFSQNPCGGGEGKSTGANPGVPPRPTWTSPTKEVGGVPCSLRGQEESAKLRSRSRRTPGTRQEVSVRPQRIHMPGSPGDTKPALGN

SEQ ID NO: 804988 - protein, 121 aa, Homo sapiens
DQRHPIPDPRAVAWAWQGGRLLGHHLRGPQGFGLGAGSAALLQALAVLAFRLTLPPLKQGIFRERKREPAEPRSVWRSHVSHGKPAHKTQQNPTQRSVLYRAHGLGACLKEDRPVYFCGCF

SEQ ID NO: 804989 - protein, 108 aa, Homo sapiens
QQRTINMQQSQVEKYKTLFEEANKKYDGLQQQLSSVERELENKRRLQKQAASSQSATEVRLNRALEEAEKYKLELSKLRQNNKMHIEAAKMLSFTEEEFMKALEWGNS

SEQ ID NO: 804990 - protein, 153 aa, Homo sapiens
QQRTINMQQSQVEKYKTLFEEANKKYDGLQQQLSSVERELENKRRLQKQAASSQSATEVRLNRALEEAEKYKLELSKLRQNNKDIANEEHKKIEVLKSENKKLEKQKGELMIGFKKQLKLIDVLKRQKMHIEAAKMLSFTEEEFMKALEWGNS

SEQ ID NO: 804991 - protein, 80 aa, Homo sapiens
SAQSSTPAFGVRGGKEQKQEPRDHSRLTRLGSPGTGHLGKSREDMAWSGKKVRMKKTVVQGDSQCLNHMAASCCHNPLAH

SEQ ID NO: 804992 - protein, 75 aa, Homo sapiens
RTEVPDVFTEFPNAISSFAISVPAIRPHVASAQSSTPAFGVRGGKEQKQEPRDHSRLTRYGRCRLNFYKTKPIRP

SEQ ID NO: 804993 - protein, 192 aa, Homo sapiens
MALLRKSYSEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 804994 - protein, 245 aa, Homo sapiens
MAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 804995 - protein, 245 aa, Homo sapiens; identical to SEQ ID NO: 804994

SEQ ID NO: 804996 - protein, 255 aa, Homo sapiens
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 804997 - protein, 226 aa, Homo sapiens
MLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 804998 - protein, 261 aa, Homo sapiens
MRTSMKKVGMHHLSSSGGSYYLILDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 804999 - protein, 226 aa, Homo sapiens; identical to SEQ ID NO: 804997

SEQ ID NO: 805000 - protein, 226 aa, Homo sapiens; identical to SEQ ID NO: 804997

SEQ ID NO: 805001 - protein, 187 aa, Homo sapiens
MSGKVTKPKEEKDASKEPQLKGIVTKLYSRQGYHLQLQADGTIDGTKDEDSTYTLFNSSLWRSCQERSGVWGTFEFPPKTGTTAFPRKEPPEKTALGLNLFWGGPQKRLGPKNPERFADNGADKFHRLCGLNQEPQFQGPKTLFSLPKPNPPLGERVGPEEQFFRRLRPTIPKVVFILGERNFAILT

SEQ ID NO: 805002 - protein, 116 aa, Homo sapiens
MSGKVTKPKEEKDASKGKPARRVRLLSFPSFPSPPRVRAALRRLLASFPEPKLPMTSATPGEKGGQRSLGGGSRFAPLSLLPRGIVDPRVPPASSTSPLDARWWRCGQTKLLQPGA

SEQ ID NO: 805003 - protein, 394 aa, Homo sapiens
MAVPPSAPQPRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALGPSCVSSTMTASLQCCRVGNRHGEIARLTLSGLFPGVSLLLGSLGPHPEPVLHHRL

SEQ ID NO: 805004 - protein, 386 aa, Homo sapiens
MAVPPSAPQPRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 805005 - protein, 345 aa, Homo sapiens
MAVPPSAPQPRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 805006 - protein, 386 aa, Homo sapiens; identical to SEQ ID NO: 805004

SEQ ID NO: 805007 - protein, 386 aa, Homo sapiens; identical to SEQ ID NO: 805004

SEQ ID NO: 805008 - protein, 208 aa, Homo sapiens
MAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 805009 - protein, 225 aa, Homo sapiens
MGSLSRPSFSDRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 805010 - protein, 141 aa, Homo sapiens
MWIAYSPGIQDQPRQCGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 805011 - protein, 148 aa, Homo sapiens
QGFGWLVSWLHGAVLPAGTWTSKSHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 805012 - protein, 385 aa, Homo sapiens
MAVPPSAPQPRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKLLGPSWLWPRK

SEQ ID NO: 805013 - protein, 145 aa, Homo sapiens
TARAPHAWGELPARRQAMQPPLRLRSQDQPGQEGPGDTEASQTEPGSSAVTLQEQPSLSQNESDVFSWVIRREFQELRHPVDEEKARCLEGIGGHTRGLVASLDMQLEQAQGTRERLAQAECVLEQFGNEDHHEFIWKFHSMASR

SEQ ID NO: 805014 - protein, 315 aa, Homo sapiens
MPELLVFPAQTDLHEHPLYRAGHLILQDRASCLPAMLLDPRQAPMSWMPVPPQAIKTSHLAALLKNQGKIFAFDLDARRLASMATLLAWAGVSCCELAEEDFLAVSPLDPRYREVHYVLLDPSCSGSGMPSRQLEEPGAGTPSPVRLHALAGFQQRALCHALTFPSLQRLVYSMCSLCQEENEDMVQDALQQNPGAFRLAPALPARPHRGLSTFPGAEHCLRASPKTTLSGGFFVAVIERVEMPTSASQAKASAPERTPSPAPKRKKRAKSCSRCLHTALHIAEAPGSLLPGGKGRCLSSPWRTLGPHRRQQFAF

SEQ ID NO: 805015 - protein, 315 aa, Homo sapiens; identical to SEQ ID NO: 805014

SEQ ID NO: 805016 - protein, 81 aa, Homo sapiens
RGNMGLYAAVAGVLAGVESRQGSIKGLVYSSNFQNVKQLYALVCETQRYSAVLDAVISSAGLLSAKKLQPHLAKGRGGAGK

SEQ ID NO: 805017 - protein, 78 aa, Homo sapiens
RGNMGLYAAVAGVLAGVESRQGSIKGLVYSSNFQNVKQLYALVCETQRYSAVLDAVISSAGLLSAKKLQPHLAKGASV

SEQ ID NO: 805018 - protein, 366 aa, Homo sapiens
RGTWGCTLRWQACWPAWRAARALSRGWCTPATSSLDDLRALKGKHFLLDPLMPELLVFPAQTDLHEHPLYRAGHLILQDRASCLPAMLLDPRQAPMSWMPVPPQAIKTSHLAALLKNQGKIFAFDLDARRLASMATLLAWAGVSCCELAEEDFLAVSPLDPRYREVHYVLLDPSCSGSGMPSRQLEEPGAGTPSPVRLHALAGFQQRALCHALTFPSLQRLVYSMCSLCQEENEDMVQDALQQNPGAFRLAPALPARPHRGLSTFPGAEHCLRASPKTTLSGGFFVAVIERVEMPTSASQAKASAPERTPSPAPKRKKRAKSCSRCLHTALHIAEAPGSLLPGGKGRCLSSPWRTLGPHRRQQFAF

SEQ ID NO: 805019 - protein, 265 aa, Homo sapiens
MAWQVSLLELEDWLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASSLTSASQAAAYSWLYN

SEQ ID NO: 805020 - protein, 187 aa, Homo sapiens
MPSRQLEEPGAGTPSPVRLHALAGFQQRALCHALTFPSLQRLVYSMCSLCQEENEDMVQDALQQNPGAFRLAPALPARPHRGLSTFPGAEHCLRASPKTTLSGGFFVAVIERVEMPTSASQAKASAPERTPSPAPKRKKRAKSCSRCLHTALHIAEAPGSLLPGGKGRCLSSPWRTLGPHRRQQFAF

SEQ ID NO: 805021 - protein, 213 aa, Homo sapiens
MPELLVFPAQTDLHEHPLYRAGHLILQDRASCLPAMLLDPRQAPMSWMPVPPQAIKTSHLAALLKNQGKIFAFDLDARRLASMATLLAWAGVSCCELAEEDFLAVSPLDPRYREVHYVLLDPSCSGSGMPSRQLEEPGAGTPSPRLVYSMCSLCQEENEDMVQDALQQNPGAFRLKSRPGCRAHRRPETSRVQHWSGVPPDQLGGYSGRLTGQ

SEQ ID NO: 805022 - protein, 455 aa, Homo sapiens
AREHGAVRCGGRRAGRRGEPPGLYQGAGVLQQLPEREAAVRAGVRNAALLRRAGCRDLQRRPPQCEEAAAAPGQGLDGVPWRDLGSPQPLPPGFKRFSCFSLLSSWDYEGVACPSTSVGYLISLDDLRALKGKHFLLDPLMPELLVFPAQTDLHEHPLYRAGHLILQDRASCLPAMLLDPRQAPMSWMPVPPQAIKTSHLAALLKNQGKIFAFDLDARRLASMATLLAWAGVSCCELAEEDFLAVSPLDPRYREVHYVLLDPSCSGSGMPSRQLEEPGAGTPSPVRLHALAGFQQRALCHALTFPSLQRLVYSMCSLCQEENEDMVQDALQQNPGAFRLAPALPARPHRGLSTFPGAEHCLRASPKTTLSGGFFVAVIERVEMPTSASQAKASAPERTPSPAPKRKKRAKSCSRCLHTALHIAEAPGSLLPGGKGRCLSSPWRTLGPHRRQQFAF

SEQ ID NO: 805023 - protein, 78 aa, Homo sapiens; identical to SEQ ID NO: 805017

SEQ ID NO: 805024 - protein, 222 aa, Homo sapiens
AREHGAVRCGGRRAGRRGEPPGLYQGAGVLQQLPEREAAVRAGVRNAALLRRAGCRDLQRRPPQCEEAAAAPGQGLDDLRALKGKHFLLDPLMPELLVFPAQTDLHEHPLYRAGHLILQDRASCLPAMLLDPRQAPMSWMPVPPQAIKTSHLAALLKNQGKIFAFDLDARRLASMATLLAWAGVSCCELAEEDFLAVSPLDPRYREVHYVLLDPSCSGSGRW

SEQ ID NO: 805025 - protein, 142 aa, Homo sapiens
MCSLCQEENEDMVQDALQQNPGAFRLAPALPARPHRGLSTFPGAEHCLRASPKTTLSGGFFVAVIERVEMPTSASQAKASAPERTPSPAPKRKKRAKSCSRCLHTALHIAEAPGSLLPGGKGRCLSSPWRTLGPHRRQQFAF

SEQ ID NO: 805026 - protein, 250 aa, Homo sapiens
MAWQVSLLELEDWLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASR

SEQ ID NO: 805027 - protein, 187 aa, Homo sapiens; identical to SEQ ID NO: 805020

SEQ ID NO: 805028 - protein, 1058 aa, Homo sapiens
MDLGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFREPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLGQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRNWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQRFLKSIAEGIGPEERRQTLLQKMSSF

SEQ ID NO: 805029 - protein, 1047 aa, Homo sapiens
MTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFREPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLGQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRNWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQRFLKSIAEGIGPEERRQTLLQKMSSF

SEQ ID NO: 805030 - protein, 1047 aa, Homo sapiens; identical to SEQ ID NO: 805029

SEQ ID NO: 805031 - protein, 1062 aa, Homo sapiens
MFEACSQGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFREPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLGQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRNWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQRFLKSIAEGIGPEERRQTLLQKMSSF

SEQ ID NO: 805032 - protein, 1062 aa, Homo sapiens; identical to SEQ ID NO: 805031

SEQ ID NO: 805033 - protein, 971 aa, Homo sapiens
MDLGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWERTTRQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFREPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLGQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRNWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQRFLKSIAEGIGPEERRQTLLQKMSSF

SEQ ID NO: 805034 - protein, 1058 aa, Homo sapiens; identical to SEQ ID NO: 805028

SEQ ID NO: 805035 - protein, 1058 aa, Homo sapiens; identical to SEQ ID NO: 805028

SEQ ID NO: 805036 - protein, 1058 aa, Homo sapiens; identical to SEQ ID NO: 805028

SEQ ID NO: 805037 - protein, 116 aa, Homo sapiens
THTHHAPRHHHHAHRRRFLELFPPVLCLRHLHPMSCPDLVFWAWLLLLLFKRSLWFYEGCLAGRGWARPGFRCLWPCQPREEAAEAEQLLLKTARDSSSQPPPAALSTPLSLPSGC

SEQ ID NO: 805038 - protein, 107 aa, Homo sapiens
VGAGRTVTPSLRVNTGLDCQKGPRPGTRDDAGPGDAFLEAEKPGGRPPKLLSSPTPWSQRERRWAVPQQGRRHCRGITLVRACWHGGHSAQGGRTHAPNGRHAVVPA

SEQ ID NO: 805039 - protein, 81 aa, Homo sapiens
VGAGRTVTPSLRVNTGLDCQKGPRPGTRDDAGPGDAFLEAEKPGGRPPKLLSSPTPWSQRERSIPKEHSSLSLKEPLRLGV

SEQ ID NO: 805040 - protein, 81 aa, Homo sapiens; identical to SEQ ID NO: 805039

SEQ ID NO: 805041 - protein, 50 aa, Homo sapiens
MFNHQESSRRRGRGTGRGDCAQNEGSGQKQLRKRAKAGRRVTAGGGHQRP

SEQ ID NO: 805042 - protein, 579 aa, Homo sapiens
GVRSSRQRPHPGALRNPTACPLPHFPPSLPPTHSPTHPPRAGTAAQAPGPRRLLAAILDFLLLQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 805043 - protein, 562 aa, Homo sapiens
GVRSSRQRPHPGALRNPTACPLPHFPPSLPPTHSPTHPPRAGTAAQAPGPRRLLAAILDFLLLQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 805044 - protein, 305 aa, Homo sapiens
MEKGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 805045 - protein, 171 aa, Homo sapiens
MGHHHHHHHHHHSSGHIEGRDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 805046 - protein, 305 aa, Homo sapiens; identical to SEQ ID NO: 805044

SEQ ID NO: 805047 - protein, 107 aa, Homo sapiens
LRLFLDFLQSQCTSCRACVGKSARTHRRESLMKARACWKTNRAFEKRGAAFVLTRARDLYCLNTPSNDHLQACAATPVRRHAGQYERRGSQHRHKTLCYYFRLTCGC

SEQ ID NO: 805048 - protein, 107 aa, Homo sapiens; identical to SEQ ID NO: 805047

SEQ ID NO: 805049 - protein, 271 aa, Homo sapiens
ALRARAGSAAAAGGQAGRPAGGCAEGWCPAAGGRGAVGGGGWAGGCRLRSGRARRPCGHAMDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATTVPDFQETRPRNYILSASASAALE

SEQ ID NO: 805050 - protein, 216 aa, Homo sapiens
GTREHLAFWKNPCLGWDCARQTRWHGPEPTWTDFCTEANKWRVGWWVGEFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRFLQNPPLDLVSCQRGSKRAQGLKPQPPF

SEQ ID NO: 805051 - protein, 207 aa, Homo sapiens
ALRARAGSAAAAGGQAGRPAGGCAEGWCPAAGGRGAVGGGGWAGGCRLRSGRARRPCGHAMDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYDGVSLCHPGWSAVAQSRLTASSSSRVHAILLPQPPE

SEQ ID NO: 805052 - protein, 271 aa, Homo sapiens; identical to SEQ ID NO: 805049

SEQ ID NO: 805053 - protein, 254 aa, Homo sapiens
ALRARAGSAAAAGGQAGRPAGGCAEGWCPAAGGRGAVGGGGHAMDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATTVPDFQETRPRNYILSASASAALE

SEQ ID NO: 805054 - protein, 126 aa, Homo sapiens
MLDLQKQLGARFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 805055 - protein, 126 aa, Homo sapiens; identical to SEQ ID NO: 805054

SEQ ID NO: 805056 - protein, 126 aa, Homo sapiens; identical to SEQ ID NO: 805054

SEQ ID NO: 805057 - protein, 250 aa, Homo sapiens
ALRARAGSAAAAGGQAGRPAGGCAEGWCPAAGGRGAVGGGGWAGGCRLRSGRARRPCGHAMDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATALE

SEQ ID NO: 805058 - protein, 271 aa, Homo sapiens; identical to SEQ ID NO: 805049

SEQ ID NO: 805059 - protein, 245 aa, Homo sapiens
MRHVRGTGTASPQLPCRASAQSQLLFGRGGRGAGTGSRVQLSSSPLPCWPLLLPSPQLWNDEVDKAEQELRVAQTEFDRQAEVTRLLLEGISSTHVNHLRCLHEFVKSQTTYYAQCYRHMLDLQKQLGARFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 805060 - protein, 227 aa, Homo sapiens
LLHPGGAVHGGEIWPKPRRCLTFRRLDLVITFSRPAPPRLWNDEVDKAEQELRVAQTEFDRQAEVTRLLLEGISSTHVNHLRCLHEFVKSQTTYYAQCYRHMLDLQKQLGARFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 805061 - protein, 256 aa, Homo sapiens
MGDGGRVCHCSCLWGPEWGSSFSGVGAPGVKSGIDPEGSLCSQGKGTGGSQVGSRRRLRGSWWVVCGCSWLPCPAQAEQELRVAQTEFDRQAEVTRLLLEGISSTHVNHLRCLHEFVKSQTTYYAQCYRHMLDLQKQLGARFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 805062 - protein, 316 aa, Homo sapiens
NRPAAAGSLDRSRNLEEAAATEQGGGCDQVDSSPVPRYRVNAKKLTPLLPPPLTDMDSTLDSSTGSLLKTNNHIGGGAFSVDSPQREDALSVGQRQYLGKLAAGVPNNCQEHGSVPSLGKPLPLLSLIKDTGLSQAAEQELRVAQTEFDRQAEVTRLLLEGISSTHVNHLRCLHEFVKSQTTYYAQCYRHMLDLQKQLGARFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 805063 - protein, 223 aa, Homo sapiens
MGDGGRVCHCSCLWGPEWGSSFSGVGAPGVKSGIDPEGSLCSQGKGTGGSQVGSRRRLRGSWWVVCGCSWLPCPAQAEQELRVAQTEFDRQAEVTRLLLEGISSTHVNHLRCLHEFVKSQTTYYAQCYRHMLDLQKQLGASSSLSTACLAWTLTGSLAREATRRARSLSPTWNCSARQVPPSPPHSGLGRRGWAQPCHLTCLLVTQLFRVGRIHPILSLPLVT

SEQ ID NO: 805064 - protein, 271 aa, Homo sapiens; identical to SEQ ID NO: 805049

SEQ ID NO: 805065 - protein, 271 aa, Homo sapiens; identical to SEQ ID NO: 805049

SEQ ID NO: 805066 - protein, 271 aa, Homo sapiens; identical to SEQ ID NO: 805049

SEQ ID NO: 805067 - protein, 271 aa, Homo sapiens; identical to SEQ ID NO: 805049

SEQ ID NO: 805068 - protein, 271 aa, Homo sapiens; identical to SEQ ID NO: 805049

SEQ ID NO: 805069 - protein, 271 aa, Homo sapiens; identical to SEQ ID NO: 805049

SEQ ID NO: 805070 - protein, 271 aa, Homo sapiens; identical to SEQ ID NO: 805049

SEQ ID NO: 805071 - protein, 271 aa, Homo sapiens; identical to SEQ ID NO: 805049

SEQ ID NO: 805072 - protein, 271 aa, Homo sapiens; identical to SEQ ID NO: 805049

SEQ ID NO: 805073 - protein, 338 aa, Homo sapiens
ALRARAGSAAAAGGQAGRPAGGCAEGWCPAAGGRGAVGGGGWAGGCRLRSGRARRPCGHAMDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATTVPDFQETRPRNYILSASASAFSPHTPEPSTLSNTRAPYTHTHQIPPTHTSEPNTHTPEPPTHTPEPPTHTPEPPTHTHQSLQHIHTRGTS

SEQ ID NO: 805074 - protein, 248 aa, Homo sapiens
ALRARAGSAAAAGGQAGRPAGGCAEGWCPAAGGRGAVGGGGWAGGCRLRSGRARRPCGHAMDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRFLQNPPLDLVSCQRGSKRAQGLKPQPPF

SEQ ID NO: 805075 - protein, 187 aa, Homo sapiens
ALRARAGSAAAAGGQAGRPAGGCAEGWCPAAGGRGAVGGGGWAGGCRLRSGRARRPCGHAMDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYDRILLCHPDWSAVVQS

SEQ ID NO: 805076 - protein, 122 aa, Homo sapiens
MKAWPGLVLGPEQHLPVLSSPPTPHSSSQVQRPQSSPLHTHFLSGVFTSACVCSLANKPPLCATEKKSKKKWATLTNKKPPGGARSPIGPLGGPFTIKMAAVLNRRNWKNPGFPQLIRLAEH

SEQ ID NO: 805077 - protein, 846 aa, Homo sapiens
FRHSLGRESLMTATVENLTFQKDTLGNAVDKNRRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 805078 - protein, 846 aa, Homo sapiens; identical to SEQ ID NO: 805077

SEQ ID NO: 805079 - protein, 858 aa, Homo sapiens
FRHSLGRESLMTATVENLTFQKDTLGNAVDKNTSRLELRSYSLAGRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 805080 - protein, 686 aa, Homo sapiens
METVPPPSRLKREVKGVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 805081 - protein, 753 aa, Homo sapiens
FRHSLGRESLMTATVENLTFQKDTLGNAVDKNILASLLVSTALPTSSAAPGRRTPRAAARRTRSLVTMETVPPPSRLKREVKGVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 805082 - protein, 752 aa, Homo sapiens
MRNCEEEEERLMLLESWRSFEEEFGTASDKERVDKLMPEKVKKRRKVQTDDGSDAGWEEYFDYIFPEDAANQPNLKLLAMAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 805083 - protein, 846 aa, Homo sapiens; identical to SEQ ID NO: 805077

SEQ ID NO: 805084 - protein, 438 aa, Homo sapiens
MDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 805085 - protein, 492 aa, Homo sapiens
MLFAWDFLNSLALVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 805086 - protein, 229 aa, Homo sapiens
MRNCEEEEERLMLLESWRSFEEEFGTASDKERVDKLMPEKVKKRRKVQTDDGSDAGWEEYFDYIFPEDAANQPNLKLLAMAKLWKKQQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 805087 - protein, 846 aa, Homo sapiens; identical to SEQ ID NO: 805077

SEQ ID NO: 805088 - protein, 782 aa, Homo sapiens
FRHSLGRESLMTATVENLTFQKDTLGNAVDKNRRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLFEVNEILESPLKKGIPGLRTKNPQGHLDLVDE

SEQ ID NO: 805089 - protein, 471 aa, Homo sapiens
FRHSLGRESLMTATVENLTFQKDTLGNAVDKNRRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGFLKISL

SEQ ID NO: 805090 - protein, 365 aa, Homo sapiens
FRHSLGRESLMTATVENLTFQKDTLGNAVDKNRRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKKKTKKKKKTPRESFLSLSLSLAPRGGPKRGGPPARGSPEKGGHLVSDTVGFLAESPCTVGGPVRSPAGGPLFLMRELGCPLYSPAGGAIQKTLVAPGYLGIFVGALYPSGVWGATSSLTAGLSREHVGTQRSRGSCPP

SEQ ID NO: 805091 - protein, 238 aa, Homo sapiens
EPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVGDREGPCRRWPRKGASLSPEGARVGRECSRRGEAHPERWRGRAAGGGARALVIAEHDPRWRGLRSGVVLLGSGVGWFGEDLLSQALHWALGSYARTLAT

SEQ ID NO: 805092 - protein, 412 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 805093 - protein, 412 aa, Homo sapiens; identical to SEQ ID NO: 805092

SEQ ID NO: 805094 - protein, 412 aa, Homo sapiens; identical to SEQ ID NO: 805092

SEQ ID NO: 805095 - protein, 412 aa, Homo sapiens; identical to SEQ ID NO: 805092

SEQ ID NO: 805096 - protein, 412 aa, Homo sapiens; identical to SEQ ID NO: 805092

SEQ ID NO: 805097 - protein, 412 aa, Homo sapiens; identical to SEQ ID NO: 805092

SEQ ID NO: 805098 - protein, 403 aa, Homo sapiens
MFSPSKNHALISSNQTKSQDYSENYSMTIWAFVHGFPFLGCLLSCYLPEACEKGKAYYFHLTEEDAGARWQEMTGPRPYSQEMWKRVLLWGSELLALLNPGFSDLCCWSLLPRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 805099 - protein, 403 aa, Homo sapiens; identical to SEQ ID NO: 805098

SEQ ID NO: 805100 - protein, 108 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQKHGPRSQGRGWGWQATGMC

SEQ ID NO: 805101 - protein, 138 aa, Homo sapiens
PGQYTVDVEGRGCTFIQATLKYNVLLPKKASGFSLSLEIVKNYSLTVFDLTVNLKYTGIRNKSSMVVIDVKMLSGFTPTMSSIEELENKGQVMKTEVKNDHVLFYLENVFGRADSFTFSAEQSNLVFNIQPAPGMVYD

SEQ ID NO: 805102 - protein, 144 aa, Homo sapiens
MGVLARGGRGAGSQSPPRGGCLPPCDGGPKSLGGKRGWLSSPPLRGCLQPTAMGVRRAWGGKRGRLSVPASRGEPPHTAMGVPRARGEVGLALSSRLGVCVCPAAMGVLRASGGRGAGSGRLQMTCFLSDLELCSDTCRIVNPK

SEQ ID NO: 805103 - protein, 103 aa, Homo sapiens
RLAEDASPTCNVSPKSQRWEGLALSSRLAVCACPAAMEVLRARGGRGAGSGRLQMTCFFSDPELRSDPCRIVNPSKVPAVGRSELSSWTPHTHSPPGTCRGQI

SEQ ID NO: 805104 - protein, 138 aa, Homo sapiens; identical to SEQ ID NO: 805101

SEQ ID NO: 805105 - protein, 138 aa, Homo sapiens; identical to SEQ ID NO: 805101

SEQ ID NO: 805106 - protein, 237 aa, Homo sapiens
MTRCPAGQAEVEMAELYVKPGNKERGWNDPPQFSYGLQTQAGGPRRSLLTKRVAAPQDGSPRVPASETSPGPPPMGPPPPSSKAPRSPPVGSGPASGVEPTSFPVESEARLMEDVLRPLEQALEDCRGHTRKQVCDDISRRLALLQEQWAGGKLSIPVKKRMALLVQELSSHRWDAADDIHRSLMVDHVTEVSQWMVGVKRLIAEKRSLFSEEAANEEKSAATAEKNHTIPGFQQAS

SEQ ID NO: 805107 - protein, 163 aa, Homo sapiens [sequence omitted]

SEQ ID NO: 805108 - protein, 237 aa, Homo sapiens; identical to SEQ ID NO: 805106

SEQ ID NO: 805109 - protein, 237 aa, Homo sapiens; identical to SEQ ID NO: 805106

SEQ ID NO: 805110 - protein, 163 aa, Homo sapiens [sequence omitted]

SEQ ID NO: 805111 - protein, 229 aa, Homo sapiens
PPGVDRPRVREAGNKERGWNDPPQFSYGLQTQAGGPRRSLLTKRVAAPQDGSPRVPASETSPGPPPMGPPPPSSKAPRSPPVGSGPASGVEPTSFPVESEARLMEDVLRPLEQALEDCRGHTRKQVCDDISRRLALLQEQWAGGKLSIPVKKRMALLVQELSSHRWDAADDIHRSLMVDHVTEVSQWMVGVKRLIAEKRSLFSEEAANEEKSAATAEKNHTIPGFQQAS

SEQ ID NO: 805112 - protein, 231 aa, Homo sapiens
MCTSTSPGCHFGPGALALSVIDSVRQFSYGLQTQAGGPRRSLLTKRVAAPQDGSPRVPASETSPGPPPMGPPPPSSKAPRSPPVGSGPASGVEPTSFPVESEARLMEDVLRPLEQALEDCRGHTRKQVCDDISRRLALLQEQWAGGKLSIPVKKRMALLVQELSSHRWDAADDIHRSLMVDHVTEVSQWMVGVKRLIAEKRSLFSEEAANEEKSAATAEKNHTIPGFQQAS

SEQ ID NO: 805113 - protein, 229 aa, Homo sapiens; identical to SEQ ID NO: 805111

SEQ ID NO: 805114 - protein, 80 aa, Homo sapiens
EDLGRHPGGDELSSHRWDAADDIHRSLMVDHVTEVSQWMVGVKRLIAEKRSLFSEEAANEEKSAATAEKNHTIPGFQQAS

SEQ ID NO: 805115 - protein, 145 aa, Homo sapiens
MGPPPPSSKAPRSPPVGSGPASGVEPTSFPVESEARLMEDVLRPLEQALEDCRGHTRKQVCDDISRRLALLQEQWAGGKLSIPVKKRMALLVQELSSHRWDAADDIHRSLMVDHVTEELSFNGKPTAYLRYPSRERARQLYLTQH

SEQ ID NO: 805116 - protein, 139 aa, Homo sapiens
MDPPEKQVCDDISRRLALLQEQWAGGKLSIPVKKRMALLVQELSSHRWDAADDIHRSLMVDHVTEELSFNGKTYSLLKISLQRESKAIVPDTALTPNDQIPLCPTGATKLVPAGACATDPPCRIRASLSVPIGGGIFRS

SEQ ID NO: 805117 - protein, 585 aa, Homo sapiens
TGSRLNRAMAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGMHVNGAPPLMQASMQGGVPAPGQMPAAVTGPGPGSLAPGGGMQAQVGMPGSGPVSMERGQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARAMEARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 805118 - protein, 585 aa, Homo sapiens; identical to SEQ ID NO: 805117

SEQ ID NO: 805119 - protein, 585 aa, Homo sapiens; identical to SEQ ID NO: 805117

SEQ ID NO: 805120 - protein, 568 aa, Homo sapiens
MSKEIFPFCRVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGMHVNGAPPLMQASMQGGVPAPGQMPAAVTGPGPGSLAPGGGMQAQVGMPGSGPVSMERGQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARAMEARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 805121 - protein, 233 aa, Homo sapiens
TGSRLNRAMAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKVPVMQGTGMQGASIQGGSQPGGFSPGQNQVTPQDHEKAALIMQVLQLTADQIAMLPPEQRQSILILKEQIQKSTGAP

SEQ ID NO: 805122 - protein, 365 aa, Homo sapiens
TGSRLNRAMAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALPVHGAGPGSGSNVSMNQQNPQAPQAQSLARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 805123 - protein, 70 aa, Homo sapiens
APGQMEGGVRCAYRPLTGPEPRLMVQGDSPAAASSSVLALRCLQPTRPSPNAGAPGIWAEEPGEAGRHGV

SEQ ID NO: 805124 - protein, 72 aa, Homo sapiens
YSKYHYSIKLHNKMKVIESRDGTPSGSECMYLSTKESHLHVSRVMMKSHFKVVSTGALCQMPLPIKETAELF

SEQ ID NO: 805125 - protein, 495 aa, Homo sapiens
MGSKRRNLSCSERHQKLVDENYCKKLHVQALKNVNSQIRNQMVQNENDNRVQRKQFLRLLQNEQFELDMEEAIQKAEENKRLKELQLKQEEKLAMELAKLKHESLKDEKMRQQVRENSIELRELEKKLKAAYMNKERAAQIAEKDAIKYEQMKRDAEIAKTMMEEHKRIIKEENAAEDKRNKAKAQYYLDLEKQLEEQEKKKQEAYEQLLKEKLMIDEIVRKIYEEDQLEKQQKLEKMNAMRRYIEEFQKEQALWRKKKREEMEEENRKIIEFANMQQQREEDRMAKVQENEEKRLQLQNALTQKLEEMLRQREDLEQVRQELYQEEQAEIYKSKLKEEAEKKLRKQKEMKQDFEEQMALKELVLQAAKEEEENFRKTMLAKFAEDDRIELMNAQKQRMKQLEHRRAVEKLIEERRQQFLADKQRELEEWQLQQRRQGFINAIIEEERLKLLKEHATNLLGYLPKGVFKKEDDIDLLGEEFRKVYQQRSEICEEK

SEQ ID NO: 805126 - protein, 31 aa, Homo sapiens
MVPLSSTVSRILNIAKINLASLASAVELCGS

SEQ ID NO: 805127 - protein, 306 aa, Homo sapiens
RVAAEPGAARGMVDSVYRTRSLGVAAEGLPDQYADGEAARVWQLYIGDTRSRTAEYKAWLLGLLRQHGCQRVLDVACGTGVDSIMLVEEGFSVTSVDASDKMLKYALKERWNRRHEPAFDKWVIEEANWMTLDKDVPQSAEGGFDAVICLGNSFAHLPDCKGDQSEHRLALKNIASMVRAGGLLVIDHRNYDHILSTGCAPPGKNIYYKSDLTKDVTTSVLIVNNKAHMVTLDYTVQVPGAGQDGSPGLSKFRLSYYPHCLASFTELLQAAFGGKCQHSVLGDFKPYKPGQTYIPCYFIHVLKRTD

SEQ ID NO: 805128 - protein, 178 aa, Homo sapiens
RVAAEPGAARGMVDSVYRTRSLGVAAEGLPDQYADGEAARVWQLYIGDTRSRTAEYKAWLLGLLRQHGCQRVLDVACGTGVDSIMLVEEGFSVTSVDASDKMLKYALKERWNRRHEPAFDKWVIEEANWMTLDKDVPQSAEGGFDAVICLGNSFAHLPDCKGDQSEHRLALRHISVRL

SEQ ID NO: 805129 - protein, 306 aa, Homo sapiens; identical to SEQ ID NO: 805127

SEQ ID NO: 805130 - protein, 288 aa, Homo sapiens
RVAAEPGAARGMVDSVYRTRSLGVAAEGLPDQYADGEAARVWQLYIGDTRSRTAEYKAWLLGLLRQHGCQRVLDVACGTGVDSIMLVEEGFSVTSVDASDKMLKYALKERWNRRHEPAFDKWVIEEANWMTLDKDVPQSAEGGFDAVICLGNSFAHLPDCKGDQSEHRLALNYDHILSTGCAPPGKNIYYKSDLTKDVTTSVLIVNNKAHMVTLDYTVQVPGAGQDGSPGLSKFRLSYYPHCLASFTELLQAAFGGKCQHSVLGDFKPYKPGQTYIPCYFIHVLKRTD

SEQ ID NO: 805131 - protein, 116 aa, Homo sapiens
TRAPGPKPGRGVSARSPAIGQVGLSAASSAYALSAERVAAEPGAARGMVDSVYRTRSLGVAAEGLPDQYADGEAARVWQLYIGDTRSRTAEYKAWLLGLLRQHGCQRVLDVACGTG

SEQ ID NO: 805132 - protein, 63 aa, Homo sapiens
ESGAQHDGDGGARAEDREKPVLECNDSTSVHQPLLGSSNSPASASQVAGITGICHHDQLILYL

SEQ ID NO: 805133 - protein, 128 aa, Homo sapiens [sequence omitted]

SEQ ID NO: 805134 - protein, 136 aa, Homo sapiens
MRTGGDNAGPSHSHIKRLPTSGLSTWLQGTQTCVLHLPTGTRPPAHHPLLGYSSRRSYRLLENPAAGCWARFSFCQGAAWDWDLEGVQWLRALAGGVSTAPSAPPGNLVFLSVSIFLCGSLLLETCPAYFSSLDPD

SEQ ID NO: 805135 - protein, 185 aa, Homo sapiens
MAGPRPRWRDQLLFMSIIVLVIVVICLMLYALLWEAGNLTDLPNLRIGFYNFCLWNEDTSTLQCHQFPELEALGVPRVGLGLARLGVYGSLVLTLFAPQPLLLAQCNSDERAWRLAVGFLAVSSVLLAGGLGLFLSYVWKWVRLSLPGPGFLALGSAQALLILLLIAMAVFPLRAERAESKLESC

SEQ ID NO: 805136 - protein, 185 aa, Homo sapiens; identical to SEQ ID NO: 805135

SEQ ID NO: 805137 - protein, 184 aa, Homo sapiens [sequence omitted]

SEQ ID NO: 805138 - protein, 196 aa, Homo sapiens
LSVALSQRGQLGLQRAVLRLQLMHLLDEHGEAVVEALQLLLLVGADDLVLVGARRRLAQVQPVGRRRPAIGQAEAERRGRGAGGRGGHIAAGQRLRAEAARAAGPREAGGQARAIPEHLAVGGGGAQVVLRAEAHGAGIGAGRAASTRATEERRGLSAVAPISAHCNLRLLGSKWSSRLSLPKCWDYRCEPPHLAA

SEQ ID NO: 805139 - protein, 102 aa, Homo sapiens
MAQARTTSCWKGGCRLLCLEHYILKYFERSIFKPGDFTCKEIGFLASSENGKSWDAHSGRGLSAVAPISAHCNLRLLGSKWSSRLSLPKCWDYRCEPPHLAA

SEQ ID NO: 805140 - protein, 561 aa, Homo sapiens
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQGMVTFEDTAVSLTWEEWERLDPARRDFCRESAQKDSGSTVPPSLESRVENKELIPMQQILEEAEPQGQLQEAFQGKRPLFSKCGSTHEDRVEKQSGDPLPLKLENSPEAEGLNSISDVNKNGSIEGEDSKNNELQNSARCSNLVLCQHIPKAERPTDSEEHGNKCKQSFHMVTWHVLKPHKSDSGDSFHHSSLFETQRQLHEERPYKCGNCGKSFKQRSDLFRHQRIHTGEKPYGCQECGKSFSQSAALTKHQRTHTGEKPYTCLKCGERFRQNSHLNRHQSTHSRDKHFKCEECGETCHISNLFRHQRLHKGERPYKCEECEKSFKQRSDLFKHHRIHTGEKPYGCSVCGKRFNQSATLIKHQRIHTGEKPYKCLECGERFRQSTHLIRHQRIHQNKVLSAGRGGSRL

SEQ ID NO: 805141 - protein, 201 aa, Homo sapiens
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQGMVTFEDTAVSLTWEEWERLDPARRDFCRESAQKDSGSTVPPSDTVYGP

SEQ ID NO: 805142 - protein, 104 aa, Homo sapiens [sequence omitted]

SEQ ID NO: 805143 - protein, 354 aa, Homo sapiens [sequence omitted]

SEQ ID NO: 805144 - protein, 70 aa, Homo sapiens
SPVHLLFLNSRPRRPNVKKRLVRIQPLFDIRCSVYCESVDDIEGLNAGQRLFHTQGIYGVFLHYGSPDVE

SEQ ID NO: 805145 - protein, 354 aa, Homo sapiens [sequence omitted]

SEQ ID NO: 805146 - protein, 217 aa, Homo sapiens
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQGMVTFEDTAVSLTWEEWERLDPARRDFCRESAQKDSGSTVPPSECCCSAGLLRCVVCEGLVHYHP

SEQ ID NO: 805147 - protein, 354 aa, Homo sapiens [sequence omitted]

SEQ ID NO: 805148 - protein, 66 aa, Homo sapiens
AVRGHRGDLPEPHTWCHSGVEPGSLALSSAPITAAEFTVSAQHVFTCLEDEPNPSSRGSPASMKTV

SEQ ID NO: 805149 - protein, 66 aa, Homo sapiens; identical to SEQ ID NO: 805148

SEQ ID NO: 805150 - protein, 129 aa, Homo sapiens [sequence omitted]

SEQ ID NO: 805151 - protein, 312 aa, Homo sapiens
RAPSATLLDTGESVAAVASGEDKGIAASAAAAAVFACSCSPDPQSSTMNPVYSPVQPGAPYGNPKNMAYTGYPTAYPAAAPAYNPSLYPTNSPSYAPEFQFLHSAYATLLMKQAWPQNSSSCGTEGTFHLPVDTGTENRTYQASSAAFRYTAGTPYKVPPTQSNTAPPPYSPSPNPYQTAMYPIRSAYPQQNLYAQGAYYTQPVYAAQPHVIHHTTVVQPNSIPSAIYPAPVAAPRTNGVAMGMVAGTTMAMSAGTLLTTPQHTAIGAHPVSMPTYRAQGTPAYSYVPFQLYPLPPTLHGGGWQEQKLQMKK

SEQ ID NO: 805152 - protein, 129 aa, Homo sapiens [sequence omitted]

SEQ ID NO: 805153 - protein, 129 aa, Homo sapiens [sequence omitted]

SEQ ID NO: 805154 - protein, 129 aa, Homo sapiens [sequence omitted]

SEQ ID NO: 805155 - protein, 129 aa, Homo sapiens [sequence omitted]

SEQ ID NO: 805156 - protein, 129 aa, Homo sapiens [sequence omitted]

SEQ ID NO: 805157 - protein, 129 aa, Homo sapiens [sequence omitted]

SEQ ID NO: 805158 - protein, 119 aa, Homo sapiens [sequence omitted]

SEQ ID NO: 805159 - protein, 119 aa, Homo sapiens [sequence omitted]

SEQ ID NO: 805160 - protein, 119 aa, Homo sapiens [sequence omitted]

SEQ ID NO: 805161 - protein, 210 aa, Homo sapiens
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIMVDNTKFTMDCVAPTIHVYEHHENRWRCRDPHHDYCEDWPEAQRISASLLDSRSYETLVDFDNHLDDIRNDWTNPEINKAVLHLC

SEQ ID NO: 805162 - protein, 210 aa, Homo sapiens; identical to SEQ ID NO: 805161

SEQ ID NO: 805163 - protein, 210 aa, Homo sapiens; identical to SEQ ID NO: 805161

SEQ ID NO: 805164 - protein, 126 aa, Homo sapiens
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIM

SEQ ID NO: 805165 - protein, 141 aa, Homo sapiens [sequence omitted]

SEQ ID NO: 805166 - protein, 124 aa, Homo sapiens
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAREGGLLYSLISFIVPN

SEQ ID NO: 805167 - protein, 128 aa, Homo sapiens
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDARYVDAEPSVGEEVSTCWADPVSRVLF

SEQ ID NO: 805168 - protein, 210 aa, Homo sapiens; identical to SEQ ID NO: 805161

SEQ ID NO: 805169 - protein, 141 aa, Homo sapiens [sequence omitted]

SEQ ID NO: 805170 - protein, 237 aa, Homo sapiens
MPGVKLTTQAYCKMVLHGAKYPHCAVNGLLVAEKQKPRKEHLPLGGPGAHHTLFVDCIPLFHGTLALAPMLEVALTLMEFRSVSPSLECSGVISARCNFPSRIQIDSWCKDHSYVIAGYYQANERVKDASPNQVAEKVASRIAEGFSDTALIMVDNTKFTMDCVAPTIHVYEHHENRWRCRDPHHDYCEDWPEAQRISASLLDSRSYETLVDFDNHLDDIRNDWTNPEINKAVLHLC

SEQ ID NO: 805171 - protein, 163 aa, Homo sapiens [sequence omitted]

SEQ ID NO: 805172 - protein, 827 aa, Homo sapiens
RAPAAMEEEEEAIGLLDKVLEDEDVFLLEECELGTPTSPGSGSPFLVAVKVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805173 - protein, 176 aa, Homo sapiens
MRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHELLKHNLWPPDYRCA

SEQ ID NO: 805174 - protein, 109 aa, Homo sapiens [sequence omitted]

SEQ ID NO: 805175 - protein, 882 aa, Homo sapiens
RPQRGTRDLEQREAEAKGRPGSPLAAEETPGREHLPPWRRRRFLRVPERDSPGHSSPERDSDGSRHSSDREDDFSADFSYGTDEYDGEGNEEQKGPPEGSETMPYIDESPTMSPQLSARSQGGGDGVSPTPPEGLAPGPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805176 - protein, 743 aa, Homo sapiens
MKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805177 - protein, 922 aa, Homo sapiens
RPQRGTRDLEQREAEAKGRPGSPLAAEETPGREHLPPWRRRRFLRVPERDSPGHSSPERDSDGSRHSSDREDDFSADFSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQNSSGTHCTSPPTCSPRQGGCGRVVEPAPPAWGPTQT

SEQ ID NO: 805178 - protein, 283 aa, Homo sapiens
KTLINRWRHTEIVNHIYKMPVSGGGFEAKVMFGCKVKYCWRIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805179 - protein, 179 aa, Homo sapiens
AGKQLQKLTRADSLAQDDPTYNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805180 - protein, 156 aa, Homo sapiens
AAQVRAAGVVQGGKETYAFQFLEAGFPRVWSAGFGSFLLSLSSLSWTPGWRDWFRHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805181 - protein, 100 aa, Homo sapiens
LHRCELPALYKVAQETYAFQFLEAGFPRVWSAGFGSSLLQSFKSDVGPQAGVSKDEAKDREPSLRLPVSPQVQVLLYYLQHPPISFAELKRNTLYFSTDV

SEQ ID NO: 805182 - protein, 915 aa, Homo sapiens
RPQRGTRDLEQREAEAKGRPGSPLAAEETPGREHLPPWRRRRFLRVPERDSPGHSSPERDSDGSRHSSDREDDFSADFSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805183 - protein, 915 aa, Homo sapiens; identical to SEQ ID NO: 805182

SEQ ID NO: 805184 - protein, 915 aa, Homo sapiens; identical to SEQ ID NO: 805182

SEQ ID NO: 805185 - protein, 911 aa, Homo sapiens
RPQRGTRDLEQREAEAKGRPGSPLAAEETPGREHLPPWRRRRFLRVPERDSPGHSSPERDSDGSRHSSDREDDFSADFSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQPGPPLLPTATITKTGPSLNASIAAA

SEQ ID NO: 805186 - protein, 77 aa, Homo sapiens
ESCRGGCPPPILTLHPRRERSKVPYIVRQCVEEVEKRGIEEVGIYRISGVATDIQALKAVFDASESGRPSRGRCGCV

SEQ ID NO: 805187 - protein, 859 aa, Homo sapiens
MEPLSHRGLPRLSWIDTLYSNFSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805188 - protein, 191 aa, Homo sapiens
RPQRGTRDLEQREAEAKGRPGSPLAAEETPGREHLPPWRRRRFLRVPERDSPGHSSPERDSDGSRHSSDREDDFSADFSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKHAALQPCTSAMNIL

SEQ ID NO: 805189 - protein, 915 aa, Homo sapiens; identical to SEQ ID NO: 805182

SEQ ID NO: 805190 - protein, 769 aa, Homo sapiens
MRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805191 - protein, 689 aa, Homo sapiens
LEEHSGAAARCWSPCGSISKVAEWPGCWWAPGSLERWLHAPAAGTEAAMEILLIIRFCCNCTYALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805192 - protein, 189 aa, Homo sapiens
MLLRVKSVQCLPERGLAMERFQSEGSCRPHDNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805193 - protein, 191 aa, Homo sapiens
ADDGQGCFRGVKHLQDIRRSPEEQALKANFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 805194 - protein, 915 aa, Homo sapiens; identical to SEQ ID NO: 805182

SEQ ID NO: 805195 - protein, 915 aa, Homo sapiens; identical to SEQ ID NO: 805182

SEQ ID NO: 805196 - protein, 915 aa, Homo sapiens; identical to SEQ ID NO: 805182

SEQ ID NO: 805197 - protein, 915 aa, Homo sapiens; identical to SEQ ID NO: 805182

SEQ ID NO: 805198 - protein, 677 aa, Homo sapiens
RPQRGTRDLEQREAEAKGRPGSPLAAEETPGREHLPPWRRRRFLRVPERDSPGHSSPERDSDGSRHSSDREDDFSADFSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQVRPGRRGEAEGASRRWFQLKRNSG

SEQ ID NO: 805199 - protein, 106 aa, Homo sapiens
GLPPRPRPCPGRPALLPGTWFPASSPLRARNFGLPRLPPALPPLLRDEGRVSDLTEPPPRDGAAQPPGPAAPVLDRHPLQQYVCRAGAGPQDRDRDPRMEIGTPGS

SEQ ID NO: 805200 - protein, 840 aa, Homo sapiens
MASVFRSEEMCLSQLFLQVEAAYCCVAELGELGLVQFKDLNMNVNSFQRKFVNEVRRCESLERILRFLEDEMQNEIVVQLLEKSPLTPLPREMITLETVLEKLEGELQEANQNQQALKQSFLELTELKYLLKKTQDFFETETNLADDFFTEDTSGLLELKAVPAYMTGKLGFIAGVINRERMASFERLLWRICRGNVYLKFSEMDAPLEDPVTKEEIQKNIFIIFYQGEQLRQKIKKICDGFRATVYPCPEPAVERREMLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAPYTIITFPFLFAVMFGDCGHGTVMLLAALWMILNERRLLSQKTDNEIWNTFFHGRYLILLMGIFSIYTGLIYNDCFSKSLNIFGSSWSVQPMFRNGTWNTHVMEESLYLQLDPAIPGVYFGNPYPFGIDPIWNLASNKLTFLNSYKMKMSVILGIVQMVFGVILSLFNHIYFRRTLNIILQFIPEMIFILCLFGYLVFMIIFKWCCFDVHVSQHAPSILIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 805201 - protein, 498 aa, Homo sapiens
MLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAPYTIITFPFLFAVMFGDCGHGTVMLLAALWMILNERRLLSQKTDNEIWNLASNKLTFLNSYKMKMSVILGIVQMVFGVILSLFNHIYFRRTLNIILQFIPEMIFILCLFGYLVFMIIFKWCCFDVHVSQHAPSILIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 805202 - protein, 185 aa, Homo sapiens
MLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAILLIMEGLSAFLHALRLHWVEFQNKFYVGDGYKFSPFSFKHILDGTAEE

SEQ ID NO: 805203 - protein, 68 aa, Homo sapiens
SADTHGALDDHGEEVSGTRAPEEDSPVCTNSRMDIGSRAGWVWRAPRGSSPVTAESWEAVKVSGKGTY

SEQ ID NO: 805204 - protein, 582 aa, Homo sapiens
MLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAPYTIITFPFLFAVMFGDCGHGTVMLLAALWMILNERRLLSQKTDNEIWNTFFHGRYLILLMGIFSIYTGLIYNDCFSKSLNIFGSSWSVQPMFRNGTWNTHVMEESLYLQLDPAIPGVYFGNPYPFGIDPIWNLASNKLTFLNSYKMKMSVILGIVQMVFGVILSLFNHIYFRRTLNIILQFIPEMIFILCLFGYLVFMIIFKWCCFDVHVSQHAPSILIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 805205 - protein, 349 aa, Homo sapiens
MFGDCGHGTVMLLAALWMILNERRLLSQKTDNEIWNLASNKLTFLNSYKMKMSVILGIVQMVFGVILSLFNHIYFRRTLNIILQFIPEMIFILCLFGYLVFMIIFKWCCFDVHVSQHAPSILIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 805206 - protein, 582 aa, Homo sapiens; identical to SEQ ID NO: 805204

SEQ ID NO: 805207 - protein, 141 aa, Homo sapiens
RRGVGRKTPVVQPGRGTRNVNLKSSSDPEASLTPPPVPTLQVAPEAPCPQSHLSFTSEGSSGTSRGATGKSMGHSSQRPVSSRARCWTRSGWRLKESGEEEEDKSSEAAQRCRAQEPGASSAAALLASSVPALPIKILFIS

SEQ ID NO: 805208 - protein, 121 aa, Homo sapiens
MDTKECLLSTEEIFLAKIEKFINIHQNSFLVLSAALHGPEEWKLMFRIQQRFLGCNLRILPVHNTVNAINLMCTIAKTTSKPYIDSICYRMITAKAYIIEQSPVWKTLQKIKLNSDSVNPN

SEQ ID NO: 805209 - protein, 357 aa, Homo sapiens
DGSKGAKTMAKAGDKSGSSGKKSLKRKAAAEELQEAAGAGDGATENGVQPPKAAAFPPGFSISEIKNKQRRHLMFTRWKQQQRKEKLAAKKKLKKEREALGDKAPPKPVPKTIDNQRVYDETTVDPNDEEVAYDEATDEFASYFNKQTSPKILITTSDRPHGRTVRLCEQLSTVIPNSHVYYRRGLALKKIIPQCIARDFTDLIVINEDRKTPNGLILSHLPNGPTAHFKMSSVRLRKEIKRRGKDPTEHIPEIILNNFTTRLGHSIGRMFASLFPHNPQFIGRQVATFHNQRDYIFFRFHRYIFRSEKKVGIQELGPRFTLKLRSLQKGTFDSKYGEYEWVHKPREMDTSRRKFHL

SEQ ID NO: 805210 - protein, 357 aa, Homo sapiens; identical to SEQ ID NO: 805209

SEQ ID NO: 805211 - protein, 330 aa, Homo sapiens
TEAKEPRASLSFFKFFLSCQLFLPQAAAFPPGFSISEIKNKQRRHLMFTRWKQQQRKEKLAAKKKLKKEREALGDKAPPKPVPKTIDNQRVYDETTVDPNDEEVAYDEATDEFASYFNKQTSPKILITTSDRPHGRTVRLCEQLSTVIPNSHVYYRRGLALKKIIPQCIARDFTDLIVINEDRKTPNGLILSHLPNGPTAHFKMSSVRLRKEIKRRGKDPTEHIPEIILNNFTTRLGHSIGRMFASLFPHNPQFIGRQVATFHNQRDYIFFRFHRYIFRSEKKVGIQELGPRFTLKLRSLQKGTFDSKYGEYEWVHKPREMDTSRRKFHL

SEQ ID NO: 805212 - protein, 357 aa, Homo sapiens; identical to SEQ ID NO: 805209

SEQ ID NO: 805213 - protein, 302 aa, Homo sapiens
DGSKGAKTMAKAGDKSGSSGKKSLKRKAAAEELQEAAGAGDGATENGVQPPKAAAFPPGFSISEIKNKQRRHLMFTRWKQQQRKEKLAAKKKLKKEREALGDKAPPKPVPKTIDNQRVYDETTVDPNDEEVAYDEATDEFASYFNKQTSPKILITTSDRPHGRTVRLCEQLSTVIPNSHVYYRRGLALKKIIPQCIARDFTDLIVINEDRKTPNGLILSHLPNGPTAHFKMSSVRLRKEIKRRGKDPTEHIPEIILNNFTTRLGHSIGRMFASLFPHNPQFIGRQVAHNFPPTTPQKKIFFP

SEQ ID NO: 805214 - protein, 392 aa, Homo sapiens
SNHVLCEHGGQGDCSISDVCETQDGDEPRATPLVRHNVQRIGCRRRLERVCVAEEDYTEEVANSADDLRLHLYPGSRLLIFYSSKDFTSSNIRREETTSLVQPLRANNISIDTRMRCVSGTRTAFRDSVVEFMSRYVIYRIHWSAGFIDNQRVYDETTVDPNDEEVAYDEATDEFASYFNKQTSPKILITTSDRPHGRTVRLCEQLSTVIPNSHVYYRRGLALKKIIPQCIARDFTDLIVINEDRKTPNGLILSHLPNGPTAHFKMSSVRLRKEIKRRGKDPTEHIPEIILNNFTTRLGHSIGRMFASLFPHNPQFIGRQVATFHNQRDYIFFRFHRYIFRSEKKVGIQELGPRFTLKLRSLQKGTFDSKYGEYEWVHKPREMDTSRRKFHL

SEQ ID NO: 805215 - protein, 409 aa, Homo sapiens
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 805216 - protein, 409 aa, Homo sapiens; identical to SEQ ID NO: 805215

SEQ ID NO: 805217 - protein, 402 aa, Homo sapiens
MKTSSPKENCLFLCFTSMKNGQEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 805218 - protein, 300 aa, Homo sapiens
MTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 805219 - protein, 313 aa, Homo sapiens
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKLYSFSECHLHPGSRLKEQPLFGTCPHGIRQRARKLVDYRREPPQLAHELIFQFISVYFQRTNWHDKSCINEKLHVKKHFTTYKAYL

SEQ ID NO: 805220 - protein, 300 aa, Homo sapiens; identical to SEQ ID NO: 805218

SEQ ID NO: 805221 - protein, 360 aa, Homo sapiens
MDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 805222 - protein, 193 aa, Homo sapiens
MFKNTFQSGFLSILYSIGSKPLQIWDKKVRNGHIKRITDNDIQSLVLEIEGTNVSTTYITCPADPKKTLGIKLPFLVMIIKNLKKYFTFEVQVLDDKNVRRRFRASNYQSTTRVKPFICTMPMRLDDGWNQIQFNLLDFTRRAYGTNYIETLRVQIHANCRIRRVYFSDRLYSEDELPAEFKLYLPVQNKAKQ

SEQ ID NO: 805223 - protein, 193 aa, Homo sapiens; identical to SEQ ID NO: 805222

SEQ ID NO: 805224 - protein, 198 aa, Homo sapiens [sequence omitted]

SEQ ID NO: 805225 - protein, 174 aa, Homo sapiens
MFKNTFQSGFLSILYSIGSKPLQIWDKKVRNGHIKRITDNDIQSLVLEIEGTNVSTTYITCPADPKKTLGIKLPFLVMIIKNLKKYFTFEVQVLDDKNVRRRFRASNYQSTTRVKPFICTMPMRLDDGWNQIQFNLLDFTRRAYGTNYIETLRVQQVLLLSQIEPWVGDRAHCV

SEQ ID NO: 805226 - protein, 102 aa, Homo sapiens
RPPTSTKFAAASTSMQIVASDGFTSQTDSTQKMSCRQSSNCISQFRTRQSNNWNCDSRDRPLDVTLLFKRKLCGGRCKNIFILVCSAVVLLFILGVACHGHR

SEQ ID NO: 805227 - protein, 133 aa, Homo sapiens
MFKNTFQSGFLSILYSIGSKPLQIWDKKVRNGHIKRITDNDIQSLVLEIEGTNVSTTYITCPADPKKTLGIKLPFLVMIIKNLKKYFTFEVQVKYVYMNVSTLGYTKVIAFELMGKSDPTKYLYPFACILFCF

SEQ ID NO: 805228 - protein, 193 aa, Homo sapiens; identical to SEQ ID NO: 805222

SEQ ID NO: 805229 - protein, 193 aa, Homo sapiens; identical to SEQ ID NO: 805222

SEQ ID NO: 805230 - protein, 174 aa, Homo sapiens; identical to SEQ ID NO: 805225

SEQ ID NO: 805231 - protein, 265 aa, Homo sapiens
MIQVGCRLTEDPWDLLTARFCQCIPAELRQDALCALSRTSVLRIGNLHITGVLRSSIQWGIVSNEEGRPEHHVLKLRSQHGFLSILYSIGSKPLQIWDKKVRNGHIKRITDNDIQSLVLEIEGTNVSTTYITCPADPKKTLGIKLPFLVMIIKNLKKYFTFEVQVLDDKNVRRRFRASNYQSTTRVKPFICTMPMRLDDGWNQIQFNLLDFTRRAYGTNYIETLRVQIHANCRIRRVYFSDRLYSEDELPAEFKLYLPVQNKAKQ

SEQ ID NO: 805232 - protein, 137 aa, Homo sapiens
LSLGKASCGNSGPCLDKVVCFFQDRASVMLLLCISQVLDDKNVRRRFRASNYQSTTRVKPFICTMPMRLDDGWNQIQFNLLDFTRRAYGTNYIETLRVQIHANCRIRRVYFSDRLYSEDELPAEFKLYLPVQNKAKQ

SEQ ID NO: 805233 - protein, 102 aa, Homo sapiens
QLSVDQSKARTDQAAVMEKGRAENALLQDSEKKRSHSSPSQIPKKILSHMTHEVTEDFSPRDPRTVVGKQDGRGCTSVTTALSLPELEREDGKEDISDPMDP

SEQ ID NO: 805234 - protein, 103 aa, Homo sapiens
MPRRHEPVWEMTGFFLPDVLLSDSSDTSEGFRLHLEPGSIFMPLSEPPSDFLTSSPDHREFLSTCECFSASVCGQRLSELVLPQSQAGKPLTPKAKMPKHWSS

SEQ ID NO: 805235 - protein, 69 aa, Homo sapiens
PPRTRSPHERARQAHSAAFRQSPPTSPQIMTSGQLQFSLGPINNRSNNHKDLRGQRKPNLTVCLQDLFT

SEQ ID NO: 805236 - protein, 159 aa, Homo sapiens
MVVGRAIRSWIKSPEASRDLSSSKRMVWLMVGIMLPTEKNRSSCHRVSVSDGVTGCGCRTLAQMMIRAFFFQAKGWECAAAEEISLKASTMGRPTRSQSDFVNSASALGWNSCSASKKPPCRIVISSQMFKGPGSCFEGDQAFRDDNVMKQLMRQNTAV

SEQ ID NO: 805237 - protein, 141 aa, Homo sapiens
MDAMRGYAAKVEELTKKEVGGVEREQRGGKMDAMRGYAAKVEELTKKEVGGVEREQRGVQDGRHEGLRGQSGGADEEGSGGRGALNKGASKMDAMRGYAAKVEELTKKEVGGVEREQRGVQDGRHEGLRGQSEEMRKKEAG

SEQ ID NO: 805238 - protein, 113 aa, Homo sapiens
MSSCRGLQGSQKDHRGPGATCKRRSLWTPRASPSKAGSQPCALKPLKGLEVPIGKEARDCHGIRGPQGGSQESLPAWAKGTAYGKAAGTRPSSRRCAQRRSGGTGSRDRADTR

SEQ ID NO: 805239 - protein, 113 aa, Homo sapiens; identical to SEQ ID NO: 805238

SEQ ID NO: 805240 - protein, 379 aa, Homo sapiens
GRGTYLSLLLPPRLCRLRSGMVRLAWMVALGLSPSFSLAKQWLLRIRCREDFTIRPLGSETRKTSAASLRAAAAARRSQNGASAAARLYRCCAQATPPAPPGTRPHEGQSRGAAGKKSRARPSQRLIGERERERKRLSGDWLPGPGPAAAPAMSMTTRAWEELDGGLGSCQALEDHSALAETQEDRASATPRLADSGSVPHDSQVAEGPSVDTRPKKMEKEPAARGTPGTGKERLKAGASPRSVPARKKAQTAPPLQPPPPPPALSEELPWGDLSLNKCLVLASLVALLGSAFQLCRDAVPGEAALQARVPEPWVPPSSAPREPSSPLPKFEAQAPPSAPPAPRARQRSDPRFPGVGRLQRTTKRSPARPPERPSGRTV

SEQ ID NO: 805241 - protein, 245 aa, Homo sapiens
KAQQSGWRPGPGPAAAPAMSMTTRAWEELDGGLGSCQALEDHSALAETQEDRASATPRLADSGSVPHDSQVAEGPSVDTRPKKMEKEPAARGTPGTGKERLKAGASPRSVPARKKAQTAPPLQPPPPPPALSEELPWGDLSLNKCLVLASLVALLGSAFQLCRDAVPGEAALQARVPEPWVPPSSAPREPSSPLPKFEAQAPPSAPPAPRARQRSDPRFPGVGRLQRTTKRSPARPPERPSGRTV

SEQ ID NO: 805242 - protein, 151 aa, Homo sapiens
GRGTYLSLLLPPRLCRLRSGMVRLAWMVALGLSPSFSLAKQWLLRIRCREDFTIRPLGSETRKTSAASLRAAAAARRSQNGASAAARLYRCCAQATPPAPPGTRPHEGQSRGAAGKKSRARPSQRLIGERERERKRLSGDWLINSDFSCGN

SEQ ID NO: 805243 - protein, 245 aa, Homo sapiens
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKYQDEYGVSSIIPNFQISQDSVGNSNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 805244 - protein, 245 aa, Homo sapiens; identical to SEQ ID NO: 805243

SEQ ID NO: 805245 - protein, 245 aa, Homo sapiens; identical to SEQ ID NO: 805243

SEQ ID NO: 805246 - protein, 245 aa, Homo sapiens; identical to SEQ ID NO: 805243

SEQ ID NO: 805247 - protein, 210 aa, Homo sapiens
RPTRSTHASRTRGSSGAHCPLCRGNVTRRERACPERALDLENIMRKFSGSCRCCAKQIKFYRMRHHYKSCKKYQDEYGVSSIIPNFQISQDSVGNSNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 805248 - protein, 151 aa, Homo sapiens
MAEDLSAATSYTEDDFYCPVCQEVLKTPVRTTACQHVNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 805249 - protein, 226 aa, Homo sapiens
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKYQDEYGVSSIIPNFQISQDSVGNSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 805250 - protein, 199 aa, Homo sapiens
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKYQDEYGVSSIIPNFQISQDSVGNSNRSETSTSDNTETYQENTSSSGHPTFKCPLCQESNFTRQRLLDHCNSNHLFQIVPVILARLPEISLVI

SEQ ID NO: 805251 - protein, 245 aa, Homo sapiens
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKYQDEYGVSSIIPNFQISQDSVGNSNRSETSTSDNTETYQENTSSSGHPTFKCPLCQESNFTRQRLLDHCNSNHLFQIVPVTCSIWVSLPWGDPSRFPVSVALYLETHLIQGMVISADENPYQRCGQSSRTSAVPGCSA

SEQ ID NO: 805252 - protein, 236 aa, Homo sapiens
MVSAIGRSSLRQGVVRPRGNSLRLRGAPVGAPLAVQAAMDSLRKMLISVAMLGAGAGVGYALLVIVTPGERRKQEMLKVEATGSPEEGCGGWRAPDWSSCELPFLPSGDATAGPKEQGGGGQDPAAIAGHSAGGSDHAGERGLEEELDGWRRRRRQREVTVRPDLPPWAPDLGLGAGIRGSLSPSWAQRRVRTEIPCQDSPGSCELPSGEHVSPKPWTDCFKVRKAGQGRDASRMW

SEQ ID NO: 805253 - protein, 144 aa, Homo sapiens
VSSSRSSLAGRLSMVSAIGRSSLRQGVVRPRGNSLRLRGAPVGAPLAVQAAMDSLRKMLISVAMLGAGAGVGYALLVIVTPGERRKQEMLKEMPLQDPRSREEAARTQQLLLATLQEAATTQENVAWRKNWMVGGEGGASGRSP

SEQ ID NO: 805254 - protein, 144 aa, Homo sapiens; identical to SEQ ID NO: 805253

SEQ ID NO: 805255 - protein, 144 aa, Homo sapiens; identical to SEQ ID NO: 805253

SEQ ID NO: 805256 - protein, 119 aa, Homo sapiens
VSSSRSSLAGRLSMVSAIGRSSLRQGVVRPRGNSLRLRGAPVGAPLAVQAAMDSLRKMLISVAMLGAGAGVGYALLVIVTPGERRKQEMLKEAATTQENVAWRKNWMVGGEGGASGRSP

SEQ ID NO: 805257 - protein, 236 aa, Homo sapiens; identical to SEQ ID NO: 805252

SEQ ID NO: 805258 - protein, 195 aa, Homo sapiens
RQPAPAMASGAGGSWGRSPPQSAVPTPWVTFLQPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPSIQHCPASREREVRAVPPPPPPSATGTVGADVPPASDYYDAESLL

SEQ ID NO: 805259 - protein, 255 aa, Homo sapiens
ERLSLGDGRVGSCPWRGQILEGWGTRRDSPKPRGRGVAGSREATGRGGENLAPAGLGRPLAGRGWGSRRVPIHSRHRTWLSPRTPPPWVTFLQPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPSIQHCPASREREVRAVPPPPPPSATGTVGADVPPASDYYDAESLL

SEQ ID NO: 805260 - protein, 356 aa, Homo sapiens
RQPAPAMASGAGGSWGRSPPQSAVPTPWVTFLQPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPSIQHCPASREREVRAVPPPPPPSATGTVGADVPPASDYYDAESLLGGQTPALGTAPASCSGYSPGAASCTSLVDSPVPMAGSPSHSLNLSQALFSWGNQSLPHANEFLDGPDLCCCVPIRCWRKCWPKMKQSRTDVTNRDSNTDTTVTMMTIWLSDTGSGEGGGKGLRRPVIPVTRDQKGVEVHPQPRPPDPAARSCIQQSPQLQR

SEQ ID NO: 805261 - protein, 121 aa, Homo sapiens
MRSPSSLVMEQEGRGGFLLLSTALKAPLRWLEGPRVVGERLCWAAPLSRVSSLGPPPLIPGSSSVGRKERSELCPAVARSGLRSPGARWEQCVLCPLGQGVFPPPSLSSNELLGPDGGLLH

SEQ ID NO: 805262 - protein, 513 aa, Homo sapiens
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 805263 - protein, 513 aa, Homo sapiens; identical to SEQ ID NO: 805262

SEQ ID NO: 805264 - protein, 116 aa, Homo sapiens
FFGLGFRICFMTVDFTPGGLSPRKTQGTGYLARTSSGFPGASGKWELLQSWRLPSFLSPVLQVLYLVDQKLRSVFSLMLIGKKTEPIKLVLNRVMVTKINGGIVLLPGRIFLVPLK

SEQ ID NO: 805265 - protein, 112 aa, Homo sapiens
PKTRPSPEPGAGARAWTRTWPPPAPPPPLPPAAPSPRRSRLAATAASSAASGPRTLGVWVEGRSGHRTQSVPRLSGRQRTPLPPPPLRRLSLAFCSERRERRAELTVILTVI

SEQ ID NO: 805266 - protein, 586 aa, Homo sapiens
PKTRPSPEPGAGARAWTRTWPPPAPPPPLPPAAPSPRRSRLAATAASSAASGPRTLGVWVEGAILGRSETQECLFFNANWEKDRTNQTGVEPCYGDKDKRRHCFATWKNISGSIEIVKQGCWLDDINCYDRIVREVRGKEDSRIVKVWKKENDKKKNEIEWTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 805267 - protein, 405 aa, Homo sapiens
MCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 805268 - protein, 148 aa, Homo sapiens
MAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 805269 - protein, 412 aa, Homo sapiens
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGKGKKYF

SEQ ID NO: 805270 - protein, 238 aa, Homo sapiens
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKHIAVSWYRADCI

SEQ ID NO: 805271 - protein, 311 aa, Homo sapiens
PKTRPSPEPGAGARAWTRTWPPPAPPPPLPPAAPSPRRSRLAATAASSAASGPRTLGVWVEGAILGRSETQECLFFNANWEKDRTNQTGVEPCYGDKDKRRHCFATWKNISGSIEIVKQGCWLDDINCYDRIVREVRGKEDSRIVKVWKKENDKKKNEIEWTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKHIAVSWYRADCI

SEQ ID NO: 805272 - protein, 194 aa, Homo sapiens
RTSGGHPLSGRRPRSEDLDIAVWLATVHLEQYADTFRRHGLATAGAARGLGHEELKQLGISATGHRKRILRLLQTGTEEGSLDPKSDSAMEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQIS

SEQ ID NO: 805273 - protein, 183 aa, Homo sapiens
MAAPQDLDIAVWLATVHLEQYADTFRRHGLATAGAARGLGHEELKQLGISATGHRKRILRLLQTGTEEGSLDPKSDSAMEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQIS

SEQ ID NO: 805274 - protein, 183 aa, Homo sapiens; identical to SEQ ID NO: 805273

SEQ ID NO: 805275 - protein, 71 aa, Homo sapiens
SPCKKQGHSRGQRLGPRRALPARGIGFSLTPQNDQGPGNGDLCSLARHPPNSTVRAPAKAGQKAVNWGEDR

SEQ ID NO: 805276 - protein, 54 aa, Homo sapiens
MHPGAHPGIILYLKYPQELSCPRTFAHAGPTTCDALFWLTTWLAPSHSLVSAQW

SEQ ID NO: 805277 - protein, 135 aa, Homo sapiens
RGLRAEGPEEREHCLPPGSPAWGVQVVSVAAVASRERRCLVNARMGTRKKVHAFVRVKPTDDFAHEMIRYGDDKRSIDIHLKKDIRRGVVNNQQTDWSFKLDGVLHDASQDLVYETVAKDVVSQALDGYNGNLIN

SEQ ID NO: 805278 - protein, 725 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 805279 - protein, 725 aa, Homo sapiens; identical to SEQ ID NO: 805278

SEQ ID NO: 805280 - protein, 725 aa, Homo sapiens; identical to SEQ ID NO: 805278

SEQ ID NO: 805281 - protein, 664 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLSSLARKEGASSPVNGKDLDYVSTSKTQLVPSSKDGDVKDMLSRDRETSSIEPLPSDSPKEELRPIRPDTPPSKPVAFEEFKNEQGSEINRIFKENKSILNERRKRASETTQHINAIKREIDVTKEALNFQKSLREKQDRKHHRLLGFPSLNHNPVPGQLP

SEQ ID NO: 805282 - protein, 725 aa, Homo sapiens; identical to SEQ ID NO: 805278

SEQ ID NO: 805283 - protein, 739 aa, Homo sapiens [sequence omitted]

SEQ ID NO: 805284 - protein, 151 aa, Homo sapiens
FSGAHQHVEPATAPASIEARCRPVRGTLRVTSHSLPCRRISSMTPEPRLGNSDTEKCTRSSSSSAPSSTIFPGRCNCAGLAGRLDTNQGGAIAHADSRSERGAAIGRASAAAVVESPRRRKPRHSASWFMCGLRSLAISTLTSHVHPPKSF

SEQ ID NO: 805285 - protein, 670 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLSSLARKEGASSPVNGKDLDYVSTSKTQLVPSSKDGDVKDMLSRDRETSSIEPLPSDSPKEELRPIRPDTPPSKPVAFEEFKNEQGSEINRIFKENKSILNERRKRASETTQHINAIKREIDVTKEALNFQKSLREKQGKCVGKRARELWGLRVMLVEAEQHLALEV

SEQ ID NO: 805286 - protein, 333 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETVCKDSQ

SEQ ID NO: 805287 - protein, 105 aa, Homo sapiens
MKRRKNGNKQYFTRMGTRKKVHAFVRVKPTDDFAHEMIRYGDDKRSIDIHLKKDIRRGVVNNQQTDWSFKLDGVLHDASQDLVYETVAKDVVSQALDGYNGNLIN

SEQ ID NO: 805288 - protein, 715 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLSSLARKEGASSPVNGKDLDYVSTSKTQLVPSSKDGDVKDMLSRDRETSSIEPLPSDSPKEELRPIRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 805289 - protein, 701 aa, Homo sapiens
MCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLSSLARKEGASSPVNGKDLDYVSTSKTQLVPSSKDGDVKDMLSRDRETSSIEPLPSDSPKEELRPIRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 805290 - protein, 221 aa, Homo sapiens
MPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 805291 - protein, 427 aa, Homo sapiens
GTRPPAQETCWLLPSGRSRARTRNPAMEDPSGAREPRARPRERDPGRRPHPDQGRTHDRPRDRPGDPRRKRSSDGNRRRDGDRDPKRDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRACCQMLEVLLNLLILACSSVSYSSTGGYTGITSLGGIYYYQFGGAYSGFDGADGEKAQQLDVQFYQLKLPMVTVAMACSGALTALCCLFVAMGVLRVPWHCPLLLVTEGLLDMLIAGGYIPALYFYFHYLSAAYGSPVCKERQALYQSKGYSGFGCSFHGADIGAGIFAALGIVVFALGAVLAIKGYRKVRKLKEKPAEMFEF

SEQ ID NO: 805292 - protein, 245 aa, Homo sapiens
GTRPPAQETCWLLPSGRSRARTRNPAMEDPSGAREPRARPRERDPGRRPHPDQGRTHDRPRDRPGDPRRKRSSDGNRRRDGDRDPKRDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRGEPFCRLFDHLLSLVVLEGMV

SEQ ID NO: 805293 - protein, 453 aa, Homo sapiens
MRPRFNSDEVLPSCVAPWAADTEPGHGRVVVWCSLMPLCVPVLDDDAGDPGIVRLPPHDLNVPATPLYSDLLCDLIPGVTTDCSVICCYAMLDGVNAVREMCDCGDLVTPIDDDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRACCQMLEVLLNLLILACSSVSYSSTGGYTGITSLGGIYYYQFGGAYSGFDGADGEKAQQLDVQFYQLKLPMVTVAMACSGALTALCCLFVAMGVLRVPWHCPLLLVTEGLLDMLIAGGYIPALYFYFHYLSAAYGSPVCKERQALYQSKGYSGFGCSFHGADIGAGIFAALGIVVFALGAVLAIKGYRKVRKLKEKPAEMFEF

SEQ ID NO: 805294 - protein, 427 aa, Homo sapiens; identical to SEQ ID NO: 805291

SEQ ID NO: 805295 - protein, 351 aa, Homo sapiens
MPGPPRSLEMGLLTFRDVAIEFSLEEWQHLDIAQQNLYRNVMLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGKAFNRSSTFTKHKVIHTGVKPYKCEECGKAFFWSSTLTKHKRIHTGEQPYKWEKFGKAFNRSSHLTTDKITHWREILQV

SEQ ID NO: 805296 - protein, 124 aa, Homo sapiens
SSLNISDGVIMTCDFILQQSELILPPEPSPQKGLSHIVGPRIEGLLTFRDVAIEFSLEEWQHLDIAQQNLYRNVMLENYRNLAFLGIAVSKPDLITCLEQGKEPWNMKRHEMVDEPPGLDFSLL

SEQ ID NO: 805297 - protein, 351 aa, Homo sapiens; identical to SEQ ID NO: 805295

SEQ ID NO: 805298 - protein, 402 aa, Homo sapiens
LCDGLCCPVICRSGETHSYDVRTSWKLGKGLAISKLDLVTFLEGKKEPWTVKSEETIAAQPGLLTFRDVAIEFSLEEWQHLDIAQQNLYRNVMLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGKAFNRSSTFTKHKVIHTGVKPYKCEECGKAFFWSSTLTKHKRIHTGEQPYKWEKFGKAFNRSSHLTTDKITHWREILQV

SEQ ID NO: 805299 - protein, 310 aa, Homo sapiens
MLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGKAFNRSSTFTKHKVIHTGVKPYKCEECGKAFFWSSTLTKHKRIHTGEQPYKWEKFGKAFNRSSHLTTDKITHWREILQV

SEQ ID NO: 805300 - protein, 223 aa, Homo sapiens
FDGDSLICFHIKPNTKAFIIERSPTNVKNVEKPLIGPQPLLIIGKFILKRNLTNVKNITNLPFSQSSTLTTHKIIHTGEKPYKCEECGKAFNWSSTLTKHKIIHTEEKPYKCEKCGKAFKQSSILTNHKRIHTGEKPYKCEECGKAFNRSSTFTKHKVIHTGVKPYKCEECGKAFFWSSTLTKHKRIHTGEQPYKWEKFGKAFNRSSHLTTDKITHWREILQV

SEQ ID NO: 805301 - protein, 273 aa, Homo sapiens
MVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGKAFNRSSTFTKHKVIHTGVKPYKCEECGKAFFWSSTLTKHKRIHTGEQPYKWEKFGKAFNRSSHLTTDKITHWREILQV

SEQ ID NO: 805302 - protein, 230 aa, Homo sapiens
MPGPPRSLEMGLLTFRDVAIEFSLEEWQHLDIAQQNLYRNVMLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRK

SEQ ID NO: 805303 - protein, 262 aa, Homo sapiens
RLRHSEGQGLALIFAERYLDSPSLSCLWSSLGWVSCSASSEARSCDLCRGFLDLLSSLLTSSAPSPPRSDGILPSEKQERCESPRAKPFQVSGHHDLADKLVRVKEWGVRRCVLPLGGIAAWECGPRSTEACPGRPRPLVQSPHTQLAGSGTGVGPRSPGRRPGMENERKEVPYHEKSCEPRARPRTCNADTFRTSSSGSMGANCQARPRACEVRHWSASLLSMRGRGLCPSRSHGNLLPSRVEASWRQAYLRPPSPRLPLP

SEQ ID NO: 805304 - protein, 111 aa, Homo sapiens
RLRHSEGQGLALIFAERYLDSPSLSCLWSSLGWVSCSASSEARSCDLCRGFLDLLSSLLTSSAPSPPRSDGILPSEKQERCESPRAKPFQVSGHHDLADKLVRVKEWGVRR

SEQ ID NO: 805305 - protein, 350 aa, Homo sapiens
MASREDELRNCVVCGDQATGYHFNALTCEGCKGFFRRTVRTVSKSIGPTCPFAGSCEVSSQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 805306 - protein, 330 aa, Homo sapiens
MASREDELRNCVVCGDQATGYHFNALTCEGCKGFFRRTVSQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 805307 - protein, 291 aa, Homo sapiens
MASREDELRNCVVCGDQATGYHFNALTCEGCKGFFRRTVSQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRFLYAKLLGLLAELRSINEAYGYQIQHIQGLSAMMPLLQEICS

SEQ ID NO: 805308 - protein, 220 aa, Homo sapiens
MASREDELRNCVVCGDQATGYHFNALTCEGCKGFFRRTVSQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARGEMVLEQ

SEQ ID NO: 805309 - protein, 220 aa, Homo sapiens; identical to SEQ ID NO: 805308

SEQ ID NO: 805310 - protein, 121 aa, Homo sapiens
MAGQHLPVPRLEGVSREQFMQHLYPQRKPLVLEGIDLGPCTSKWTVDYLSQVGGKKEVKIHVAAVAQMDFIKLYLLTSWSRGQLKRNIKNSLFQRMRNTTYGHLEKTLERMLQISESSFLC

SEQ ID NO: 805311 - protein, 308 aa, Homo sapiens
MAGQHLPVPRLEGVSREQFMQHLYPQRKPLVLEGIDLGPCTSKWTVDYLSQVGGKKEVKIHVAAVAQMDFIKLYLLTSWSRGQLKRNIKNSLFQRMRNTTYGHLEKTLESVADIRKQFPLLKGDIKFPEFFKEEQFFSSVFRISSPGLQLWTHYDVMDNLLIQVTGKKRVVLFSPRDAQYLYLKGTKSEVLNIDNPDLAKYPLFSKARRYECSLEAGDVLFIPALWFHNVISEEFGVGVNIFWKHLPSECYDKTDTYGNKDPTAASRAAQILDRALKTLAELPEEYRDFYARRMVLHIQDKAYSKNSE

SEQ ID NO: 805312 - protein, 210 aa, Homo sapiens
DRVGTPSFRSFDVADIRKQFPLLKGDIKFPEFFKEEQFFSSVFRISSPGLQLWTHYDVMDNLLIQVTGKKRVVLFSPRDAQYLYLKGTKSEVLNIDNPDLAKYPLFSKARRYECSLEAGDVLFIPALWFHNVISEEFGVGVNIFWKHLPSECYDKTDTYGNKDPTAASRAAQILDRALKTLAELPEEYRDFYARRMVLHIQDKAYSKNSE

SEQ ID NO: 805313 - protein, 121 aa, Homo sapiens; identical to SEQ ID NO: 805310

SEQ ID NO: 805314 - protein, 110 aa, Homo sapiens
MAGQHLPVPRLEGVSREQFMQHLYPQRKPLVLEGIDLGPCTSKWTVDYLSQVGGKKEVKIHVAAVAQMDFIKLYLLTSWSRGQLKRNIKNSLFQRMRNTTYGHLEKTLER

SEQ ID NO: 805315 - protein, 315 aa, Homo sapiens
MAGQHLPVPRLEGVSREQFMQHLYPQRKPLVLEGIDLGPCTSKWTVDYLSQVGGKKEVKIHVAAVAQMDFISKNFVYRTLPFDQLVQRAAEEKHKEFFVSEDEKYYLRSLGEDPRKDVADIRKQFPLLKGDIKFPEFFKEEQFFSSVFRISSPGLQLWTHYDVMDNLLIQVTGKKRVVLFSPRDAQYLYLKGTKSEVLNIDNPDLAKYPLFSKARRYECSLEAGDVLFIPALWFHNVISEEFGVGVNIFWKHLPSECYDKTDTYGNKDPTAASRAAQILDRALKTLAELPEEYRDFYARRMVLHIQDKAYSKNSE

SEQ ID NO: 805316 - protein, 75 aa, Homo sapiens
MAGQHLPVPRLEGVSREQFMQHLYPQVRPSRGAEPRETSERHVFTFRTAGNWFLETQGVGKRRRTAADHWLALRP

SEQ ID NO: 805317 - protein, 106 aa, Homo sapiens
MGSAVMDTKKKKDVSSPGGSGGKKNASQKRRSLRVHIPDLSSFAMPLLDGDLEGSGKHSSRKVDSPFGPGSPSKGFFFRGPQPRPSSPMSAPVRPKTSPGSPKTVF

SEQ ID NO: 805318 - protein, 154 aa, Homo sapiens
MDLLWTFQEPRGNSGQGESVCSESLRSVLNPNSNRTSPFSGAPQLHSVGAWLPVTGPQQEGHRLAHCFQATGSWHCPASCGTRKHKISGSLILTSTLHSTDSVPDTVLSALQIVIYIVLIDWEAILILTLFLRKAYPFLGSGPVNRNVLKLCLS

SEQ ID NO: 805319 - protein, 97 aa, Homo sapiens
ERPRPQLVLDMRGVGAVARSGPGLNAPRKGHLWGHSKKAAVCKPGGEPSPETSQKSANTLISGFQLQNNEKTNFCCVLVPICNWHPNETVFCSPGNG

SEQ ID NO: 805320 - protein, 509 aa, Homo sapiens
LTPDTHCTGVSATIMSMLVVFLLLWGVTWGPVTEAAIFYETQPSLWAESESLLKPLANVTLTCQARLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 805321 - protein, 465 aa, Homo sapiens
LTPDTHCTGVSATIMSMLVVFLLLWGVTWGPVTEAAIFYETQPSLWAESESLLKPLANVTLTCQARLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPSLSPGTSEDTNSTLGPRLHQLSATRELHKGAELRFEGVGAPRSGAPVVAR

SEQ ID NO: 805322 - protein, 584 aa, Homo sapiens
KGKSTLHRTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIETDDY

SEQ ID NO: 805323 - protein, 89 aa, Homo sapiens
RGSPLCGPSLKEAKCLSLVMDDEIESEAKKESLSPGKLKLTFEELERQRQENRKKQAEEEARKRLEEEKRAFEEARRQMEVEDGPHRAL

SEQ ID NO: 805324 - protein, 230 aa, Homo sapiens
MNDISQKAEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKKPNKKTKKKHTPNNTLKNTLNPGDVVRKKIYEINRQPRSEGSPNPSRREQNKTVRVHKDNISHRTSNPRRMRETKNNTRSGSTSTTTNTRRKTSCKRPKTAEEIPPTATE

SEQ ID NO: 805325 - protein, 52 aa, Homo sapiens
IPYFCLFTAVSRQENRKKQAEEEARKRLEEEKRAFEEARRQMEVEDGPHRAL

SEQ ID NO: 805326 - protein, 675 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 805327 - protein, 661 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 805328 - protein, 575 aa, Homo sapiens
GKLLRFEEMERQRREDEKRKAEEEARRRIEEEKKAFAEARRNMEEEENETFGLSREYEELIKLKRSGSIQAKNLKSKFEKIGQFLKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 805329 - protein, 562 aa, Homo sapiens
EDPLIAFLMEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 805330 - protein, 657 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLREPKPEITWWFEGEILQDGEDYQYIERGETYCLYLPETFPEDGGEYMCKAVNNKGSAASTCILTIESKN

SEQ ID NO: 805331 - protein, 573 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 805332 - protein, 658 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQNFLFHSNFLTTSIFSVAGPKKETRSATMLTSYSFS

SEQ ID NO: 805333 - protein, 675 aa, Homo sapiens; identical to SEQ ID NO: 805326

SEQ ID NO: 805334 - protein, 536 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 805335 - protein, 202 aa, Homo sapiens
LLIDYITPPPPEKTQQTEGAACCVLPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 805336 - protein, 497 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEVYYLYI

SEQ ID NO: 805337 - protein, 347 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVRQKLTGECY

SEQ ID NO: 805338 - protein, 284 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMEVEDGPHRAL

SEQ ID NO: 805339 - protein, 471 aa, Homo sapiens
WQLAPMEPELLVRKVSALQACVRGFLVRRQFQSLRAEYEAIVREVEGDLGTLQWTEGRIPRPRFLPEKAKSHQTWKAGDRVANPEQGLWNHFPCEESEGEATWEEMVLKKSGESSANQGSLCRDHSSWLQMKQNRKPSQEKTRDTTRMENPEATDQRLPHSQPQLQELQYHRSHLAMELLWLQQAINSRKEYLLLKQTLRSPEAGPIREEPRVFLEHGEQACERDQSQPSAPLEDQSYRDRTTGELEQEDDSCHRVKSPHRSPGSLATTQKNIAGAKCREPCYSKSGPPSSIPSNSQALGDRLTKGPDDGRQTFGGTCLLQMKILEDQTPRGLKPRNHCPRKSRTQLSALYEDSNIKEMSPRKLDHKEPDCRTVRTQELGLSEDHIIWDGTLGGPEHSVLDLWRTKPPKGQAPTDRSSRDGTSNEPSHEGQKKQRTIPWRSKSPEILSSTKAGCTGEEQWRGRPWKTEPPG

SEQ ID NO: 805340 - protein, 461 aa, Homo sapiens
GSWRPWSQSCWFGRCLHCRPASGASWSDASSRACELSMRRLYERSRGRIPRPRFLPEKAKSHQTWKAGDRVANPEQGLWNHFPCEESEGEATWEEMVLKKSGESSANQGSLCRDHSSWLQMKQNRKPSQEKTRDTTRMENPEATDQRLPHSQPQLQELQYHRSHLAMELLWLQQAINSRKEYLLLKQTLRSPEAGPIREEPRVFLEHGEQACERDQSQPSAPLEDQSYRDRTTGELEQEDDSCHRVKSPHRSPGSLATTQKNIAGAKCREPCYSKSGPPSSIPSNSQALGDRLTKGPDDGRQTFGGTCLLQMKILEDQTPRGLKPRNHCPRKSRTQLSALYEDSNIKEMSPRKLDHKEPDCRTVRTQELGLSEDHIIWDGTLGGPEHSVLDLWRTKPPKGQAPTDRSSRDGTSNEPSHEGQKKQRTIPWRSKSPEILSSTKAGCTGEEQWRGRPWKTEPPG

SEQ ID NO: 805341 - protein, 163 aa, Homo sapiens
DSQTADARCGSRSRSGNEVQRCGEDLGASLGANQPNQPGPPNRSASDINATHRRCVGWVVEVTAEASGDCSFGAREAGKQLASPTRCASHICTAHTTKLRSRLLRCPSDTDKFLLCNPMRAADHESIAGPPKDSGKCGPGWPVCADLHLKVRLEGNFWRVGWC

SEQ ID NO: 805342 - protein, 225 aa, Homo sapiens
PGGKTTHIAALMHDQGEVIALDKIFNKVEKIKQNALLLGLNSIRAFCFDGTKAVKLDMVEDTEGEPPFLPESFDRILLDAPCSGMGQRPNMACTWSVKEVASYQPLQRKLFTAAVQLLKPEGVLVYSTCTITLAENEEQVAWALTKFPCLQLQPQEPQIGGEGMRGAGLSCEQLKQLQRFDPSAVPLPDTDMDSLREARREDMLRLANKDSIGFFIAKFVKCKST

SEQ ID NO: 805343 - protein, 141 aa, Homo sapiens
QRRLAWPLRKDTQIREAFHIFLQRKLFTAAVQLLKPEGVLVYSTCTITLAENEEQVAWALTKFPCLQLQPQEPQIGGEGMRGAGLSCEQLKQLQRFDPSAVPLPDTDMDSLREARREDMLRLANKDSIGFFIAKFVKCKST

SEQ ID NO: 805344 - protein, 120 aa, Homo sapiens
PGGKTTHIAALMHDQGEVIALDKIFNKVEKIKQNALLLGLNSIRAFCFDGTKAVKLDMVEDTEGEPPFLPESFDRILLDAPCSGMGQRPNMACTWSVKEVASYQPLQRKLFTAVCGGLFL

SEQ ID NO: 805345 - protein, 225 aa, Homo sapiens; identical to SEQ ID NO: 805342

SEQ ID NO: 805346 - protein, 201 aa, Homo sapiens
GGPSRPRARVAVGGPTCSARCEPVRPPPAPEQPASLHRLLSVLSPRAAIAVMLGAALRRCAVAATTRADPRGLLHSARTPGPAVAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLDKV

SEQ ID NO: 805347 - protein, 201 aa, Homo sapiens; identical to SEQ ID NO: 805346

SEQ ID NO: 805348 - protein, 161 aa, Homo sapiens
GRVGRPTRRAVMLGAALRRCAVAATTRADPRGLLHSARTPGPAVAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLDKV

SEQ ID NO: 805349 - protein, 153 aa, Homo sapiens
RERESSGRTPGPAVAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLVRVQGPAATILLSVSPGFDYSQYLI

SEQ ID NO: 805350 - protein, 85 aa, Homo sapiens
GGPSRPRARVAVGGPTCSARCEPVRPPPAPEQPASLHRLLSVLSPRAAIAVMLGAALRRCAVAATTRADPRGLLHSARTPGPAVG

SEQ ID NO: 805351 - protein, 201 aa, Homo sapiens; identical to SEQ ID NO: 805346

SEQ ID NO: 805352 - protein, 131 aa, Homo sapiens
RERESSGRTPGPAVAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLDKV

SEQ ID NO: 805353 - protein, 178 aa, Homo sapiens
GGPSRPRARVAVGGPTCSARCEPVRPPPAPEQPASLHRLLSVLSPRAAIAVMLGAALRRCAVAATTRADPRGLLHSARTPGPAVAIQSVRCYSHGSQETDEEFDARWVTYFNKPDIDAWELRKGINTLVTYDMVPEPKIIDAALRACRRLNDFASTVRILEVVKTKCKPHGWASPRIY

SEQ ID NO: 805354 - protein, 169 aa, Homo sapiens
GGPSRPRARVAVGGPTCSARCEPVRPPPAPEQPASLHRLLSVLSPRAAIAVMLGAALRRCAVAATTRADPRGLLHSARTPGPAVAIQSVRCYSHGSQETDEEFDARWVTYFNKPDIDAWELRKGINTLVTYDMVPEPKIIDAALRACRRLNDFASRGNGGGFHDGRGSH

SEQ ID NO: 805355 - protein, 183 aa, Homo sapiens
GGPSRPRARVAVGGPTCSARCEPVRPPPAPEQPASLHRLLSVLSPRAAIAVMLGAALRRCAVAATTRADPRGLLHSARTPGPAVAIQSVRCYSHGSQETDEEFDARWVTYFNKPDIDAWELRKGINTLVTYDMVPEPTVRILEVVKDKAGPHKEIYPYVIQELRPTLNELGISTPEELGLDKV

SEQ ID NO: 805356 - protein, 110 aa, Homo sapiens
RVGGRVGTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 805357 - protein, 594 aa, Homo sapiens
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 805358 - protein, 417 aa, Homo sapiens
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFREHVTTNGLQDHS

SEQ ID NO: 805359 - protein, 427 aa, Homo sapiens
MDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 805360 - protein, 427 aa, Homo sapiens; identical to SEQ ID NO: 805359

SEQ ID NO: 805361 - protein, 392 aa, Homo sapiens
MDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLEVQVWMYYMHKMDSDEVWRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 805362 - protein, 552 aa, Homo sapiens
MAVEELQSIIKRCVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 805363 - protein, 124 aa, Homo sapiens
HVMAPEENAGTKLLLQSFERRFLAARTLRSFPWQKPEAFTVDVLYCPEAIVSLVGVLRRLAACWEHQRAPEVYMAFTVRNPETCQLFTTELGWAGIRWEAEAHHDQKLFPYGEHLEMAMLNLTL

SEQ ID NO: 805364 - protein, 180 aa, Homo sapiens
QRSPAEPLNGVLEPTGEEQRKGPFGTIWNERKWKKRGTMAAVVAVCGGLGRKKLTHLVTAAVSLTHPGTHTVLWRRGCSQQVSSNEDLPISMENPYKEPLKKCILCGKHVDYKNVQLLSQFVSPFTGCIYGRHITGLCGKKQKEITKAIKRAQIMGFMPVTYKDPAYLKDPKVCNIRYRE

SEQ ID NO: 805365 - protein, 180 aa, Homo sapiens; identical to SEQ ID NO: 805364

SEQ ID NO: 805366 - protein, 89 aa, Homo sapiens
QRSPAEPLNGVLEPTGEEQRKGPFGTIWNERKWKKRGTMAAVVAVCGGLGRKKLTHLVTAAVSLTHPGTHTVLWRRGCSQQVSSNEDLR

SEQ ID NO: 805367 - protein, 180 aa, Homo sapiens; identical to SEQ ID NO: 805364

SEQ ID NO: 805368 - protein, 152 aa, Homo sapiens
QRSPAEPLNGVLEPTGEEQRKGPFGTIWNERKWKKRGTMAAVVAVCGGLGRKKLTHLVTAAVSLTHPGTHTVLWRRGCSQQVSSNEDLLLSQFVSPFTGCIYGRHITGLCGKKQKEITKAIKRAQIMGFMPVTYKDPAYLKDPKVCNIRYRE

SEQ ID NO: 805369 - protein, 152 aa, Homo sapiens; identical to SEQ ID NO: 805368

SEQ ID NO: 805370 - protein, 131 aa, Homo sapiens
ANAAARHGCERRQKGTHPGTHTVLWRRGCSQQVSSNEDLPISMENPYKEPLKKCILCGKHVDYKNVQLLSQFVSPFTGCIYGRHITGLCGKKQKEITKAIKRAQIMGFMPVTYKDPAYLKDPKVCNIRYRE

SEQ ID NO: 805371 - protein, 142 aa, Homo sapiens
QRSPAEPLNGVLEPTGEEQRKGPFGTIWNERKWKKRGTMAAVVAVCGGLGRKKLTHLVTAAVSLTHPGTHTVLWRRGCSQQVSSNEDLPISMENPYKEPLKKCILCGKHVDYKNVQLLSSLFSFLMHYGGHSGFCGGQRSKH

SEQ ID NO: 805372 - protein, 180 aa, Homo sapiens; identical to SEQ ID NO: 805364

SEQ ID NO: 805373 - protein, 180 aa, Homo sapiens; identical to SEQ ID NO: 805364

SEQ ID NO: 805374 - protein, 180 aa, Homo sapiens; identical to SEQ ID NO: 805364

SEQ ID NO: 805375 - protein, 136 aa, Homo sapiens
QRSPAEPLNGVLEPTGEEQRKGPFGTIWNERKWKKRGTMAAVVAVCGGLGRKKLTHLVTAAVSLTHPGTHTVLWRRGCSQQVSSNEDLPISMENPYKEPLKKCILCGKHVDYKNVQLQVFVGRNRKKSQKQLRELK

SEQ ID NO: 805376 - protein, 220 aa, Homo sapiens
QVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAV

SEQ ID NO: 805377 - protein, 292 aa, Homo sapiens
AAEVRSRAAFWGRKWGGCTLRVGVMAAAGSRKRRLAELTVDEFLASGFDSESESESENSPQAETREAREAARSPDKPGGSPSASRRKGRASEHKDQLSRLKDRDPEFYKFLQENDQSLLNFSDSDSSEEEEGPFHSLPDVLEEASEEEDGAEEGEDGDRVPRGLKGKKNSVPVTVAMVERWKQAAKQRLTPKLFHEVVQAFRAAVATTRGDQESAEANKFQVTDSAAFNALVTFCIRETSLAVSRSCCLERWQRIAAANVGQRKPVCGSWWCLGDPRGAEYQLLGLGTSCGL

SEQ ID NO: 805378 - protein, 69 aa, Homo sapiens
FFLNRRRLAELTVDEFLASGFDSESESESENSPQAETREAREAARSVYRCHSLVLPFIEVSPSDRHCAY

SEQ ID NO: 805379 - protein, 517 aa, Homo sapiens
MLQPSSSPLWGKLRVDIKAYLGSAIQLVSCLSETTVLAAVLRHISVLVPCFLTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805380 - protein, 517 aa, Homo sapiens; identical to SEQ ID NO: 805379

SEQ ID NO: 805381 - protein, 517 aa, Homo sapiens; identical to SEQ ID NO: 805379

SEQ ID NO: 805382 - protein, 517 aa, Homo sapiens; identical to SEQ ID NO: 805379

SEQ ID NO: 805383 - protein, 517 aa, Homo sapiens; identical to SEQ ID NO: 805379

SEQ ID NO: 805384 - protein, 517 aa, Homo sapiens; identical to SEQ ID NO: 805379

SEQ ID NO: 805385 - protein, 517 aa, Homo sapiens; identical to SEQ ID NO: 805379

SEQ ID NO: 805386 - protein, 517 aa, Homo sapiens; identical to SEQ ID NO: 805379

SEQ ID NO: 805387 - protein, 517 aa, Homo sapiens; identical to SEQ ID NO: 805379

SEQ ID NO: 805388 - protein, 517 aa, Homo sapiens; identical to SEQ ID NO: 805379

SEQ ID NO: 805389 - protein, 517 aa, Homo sapiens; identical to SEQ ID NO: 805379

SEQ ID NO: 805390 - protein, 483 aa, Homo sapiens
MLQPSSSPLWGKLRVDIKAYLGSAIQLVSCLSETTVLAAVLRHISVLVPCFLTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805391 - protein, 486 aa, Homo sapiens
MLQPSSSPLWGKLRVDIKAYLGSAIQLVSCLSETTVLAAVLRHISVLVPCFLTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERDGDPDAEAGLAPGELQQLAQGPEDELEDLQLSEDD

SEQ ID NO: 805392 - protein, 508 aa, Homo sapiens
MLQPSSSPLWGKLRVDIKAYLGSAIQLVSCLSETTVLAAVLRHISVLVPCFLTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGVHFGGWEPLTPKRRLPPGKLEPLGPR

SEQ ID NO: 805393 - protein, 527 aa, Homo sapiens
PAKGGWSLCRMLQPSSSPLWGKLRVDIKAYLGSAIQLVSCLSETTVLAAVLRHISVLVPCFLTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805394 - protein, 293 aa, Homo sapiens
MLQPSSSPLWGKLRVDIKAYLGSAIQLVSCLSETTVLAAVLRHISVLVPCFLTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805395 - protein, 573 aa, Homo sapiens
RSVSSPWGCTLRVGVMAAAGSRKRRLAELTVDEFLASGFDSESESESENSPQAETREAREAARSPDKPGGSPSASRRKGRASEHKDQLSRLKDRDPEFYKFLQENDQSLLNFSDSDSSEEEEGPFHSLPDVLEVLAFLVLSRVCRHKKDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805396 - protein, 408 aa, Homo sapiens
MCWSTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805397 - protein, 393 aa, Homo sapiens
MQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805398 - protein, 399 aa, Homo sapiens
MPSLRRVQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805399 - protein, 192 aa, Homo sapiens
MLQPSSSPLWGKLRVDIKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805400 - protein, 323 aa, Homo sapiens
RAVNRTRPAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805401 - protein, 401 aa, Homo sapiens
NDPFHPLGGARFGLVSWQLRGAARVQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805402 - protein, 157 aa, Homo sapiens
MDNLEDGFVIWEQRGLEIGHMGPWWWVWRCLALLWPPAPALSHLSPWFFGFQLEDLNFPEIKRRKMADRKDEDRKQFKDLFDLNSSEEDDTEGFSERGGGACVVLPGEGWAWRALLDFPEPRGPPVPILQGAHQSLAQLGPTSVLPGFWCQRLPSLK

SEQ ID NO: 805403 - protein, 511 aa, Homo sapiens
MLQPSSSPLWGKLRVDIKAYLGSAIQLVSCLSETTVLAAVLRHISVLVPCFLTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGGGACVVLPGEGWAWRALLDFPEPRGPPVPILQGAHQSLAQLGPTSVLPGFWCQRLPSLK

SEQ ID NO: 805404 - protein, 487 aa, Homo sapiens
ARWYLPSGMFLRGLSGRSTNDVTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805405 - protein, 192 aa, Homo sapiens
MLQPSSSPLWGKLRVDIKAYLGSAIQLVSCLSETTVLAAVLRHISVLVPCFLTFPKQCRMLLKRMVVVWSTGEESLRVLAFLVLSRVCRHKKDTFLGPVLKQMYITYVRNCKFTSPGALPFISFMQWTLTELLALEPGVAYQHAFLYIRQLAIHLRNAMTTRKKRKRHLPVGQWHICLLFRVPADMWHRTQP

SEQ ID NO: 805406 - protein, 417 aa, Homo sapiens
NDPFHPLGGARFGLVSWQLRGAARVQWTLTELLALEPGVAYQHAFLYIRQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805407 - protein, 502 aa, Homo sapiens
RSVSSPWGCTLRVGVMAAAGSRKRRLAELTVDEFLASGFDSESESESENSPQAETREAREAARSPDKPGGSPSASRRKGRASEHKDQLSRLKDRDPEFYKFLQENDQSLLNFSDSDSSEEEEGPFHSLPDVLERQLAIHLRNAMTTRKKETYQSVYNWQYVHCLFLWCRVLSTAGPSEALQPLVYPLAQVIIGCIKLIPTARFYPLRMHCIRALTLLSGSSGAFIPVLPFILEMFQQVDFNRKPGRMSSKPINFSVILKLSNVNLQEKAYRDGLVEQLYDLTLEYLHSQAHCIGFPELVLPVVLQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGDGDPDAEAGLAPGELQQLAQGPEDELEDLQLSEDD

SEQ ID NO: 805408 - protein, 303 aa, Homo sapiens
MARCEAWGLPGCTLRVGVMAAAGSRKRRLAELTVDEFLASGFDSESESESENSPQAETREAREAARSPDKPGGSPSASRRKGRASEHKDQLSRLKDRDPEFYKFLQENDQSLLNFSDSDSSEEEEGPFHSLPDVLEEASEEEDGAEEGEDGDRVPRGLKGKKNSVPVTVAMVERWKQAAKQRLTPKLFHEVVQAFRAAVATTRGDQESAEANKFQVTDSAAFNALVTFCIRETSLAVSRSCCLERWQRIAAGCCSRPAARSGGSFVWTSRLTWARPYSWCPVCRRRRCWRPCCGTSACWCPAS

SEQ ID NO: 805409 - protein, 173 aa, Homo sapiens
RSVSSPWGCTLRVGVMAAAGSRKRRLAELTVDEFLASGFDSESESESENSPQAETREAREAARSPDKPGGSPSARLVGTCVSRTSCSSCPTPVGLLTSPGVSGPRPKDRRPLPPSPFSLTYSFIRCLLSSCSVPNSVLGRERMLVSCAKISSRSRRTLTFLGEITACSSVEER

SEQ ID NO: 805410 - protein, 103 aa, Homo sapiens
MAPKHVGPQRRLWIRKEYPKTRAKDQLEPTEASPSLGFSSCGTGNQNHGILKTRGMNLPRLASHWAWTCFTANVLLPKLYKLPGLLQKRWVHKIVRTGFQGKN

SEQ ID NO: 805411 - protein, 76 aa, Homo sapiens
IWEQGQEKLAAVTQRKIKGLGLDSGGKKVLEEMKEQSGLSVCPRRAGHYLFCLTSVHKTIPEQHGASDTTRAAGSP

SEQ ID NO: 805412 - protein, 192 aa, Homo sapiens
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRQYVLCTLSRITTFDFSGVTKADRTTAEVWKRMNIKPKKAWTKQNTL

SEQ ID NO: 805413 - protein, 192 aa, Homo sapiens; identical to SEQ ID NO: 805412

SEQ ID NO: 805414 - protein, 192 aa, Homo sapiens; identical to SEQ ID NO: 805412

SEQ ID NO: 805415 - protein, 192 aa, Homo sapiens; identical to SEQ ID NO: 805412

SEQ ID NO: 805416 - protein, 174 aa, Homo sapiens
MVEFQPSVTDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRQYVLCTLSRITTFDFSGVTKADRTTAEVWKRMNIKPKKAWTKQNTL

SEQ ID NO: 805417 - protein, 114 aa, Homo sapiens
LGYGGGLPLAAASPAPLLGLSTRRGAQADAKRGPAPVTWLRAPALPRDSPESYLFVGSRQRCERTISLNYGPAPSRCPLIGLCRRGPLKDPGKGSLRATGKEKGYHRFRTPACT

SEQ ID NO: 805418 - protein, 192 aa, Homo sapiens; identical to SEQ ID NO: 805412

SEQ ID NO: 805419 - protein, 192 aa, Homo sapiens; identical to SEQ ID NO: 805412

SEQ ID NO: 805420 - protein, 176 aa, Homo sapiens
PRAEFGTRTSFNLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRQYVLCTLSRITTFDFSGVTKADRTTAEVWKRMNIKPKKAWTKQNTL

SEQ ID NO: 805421 - protein, 187 aa, Homo sapiens [sequence omitted]

SEQ ID NO: 805422 - protein, 117 aa, Homo sapiens
EEGNMQSQTMNNSKDKKVGPKELNIINPMTVKSFTEEDEDIADVVFPQGGSSVHQRGLLEGDEDERMRETSLACLLDLGLKSHSRATRSHSVPGDDSSMSFTKASSAALLFALGVYK

SEQ ID NO: 805423 - protein, 66 aa, Homo sapiens
CQMLDEDRVEHSYKKYTSHDAYMMNARRKRVGNILLDEKIRQQGCWALSRTEALELRTQPRKSSGL

SEQ ID NO: 805424 - protein, 89 aa, Homo sapiens
ISGHTGFHSSNIPETTEFWRWSTGCFTVYGKGQNVGCSRARLKSPMSFKPTQQRANSRLPDPSAKMQMDTAFWPHASEVRLKMCESLSA

SEQ ID NO: 805425 - protein, 135 aa, Homo sapiens
MPWTINVPMDLDPGELPVSWMECSAWLILPREEPGYEKMGEGRGRCETCWCFLSSWCDGCPGCSFEAGQDSHGRYEDHGDFQAPVMSQSIVCLCSGVTDSPGISSYCPLWQILHKGVLCLWTHSVSMDILFLFPW

SEQ ID NO: 805426 - protein, 175 aa, Homo sapiens
PCGGPEDVALAPCTAAAACEAGPSPVYVKVKSAEPADCAEGPVQCKNGLLVSSPHCEEPCAHSCAHPGLPPHLVHKLPLSYLQTQDTDAASRRINAPLAAGWSWLRLWLVTLASGVDFPQVSAWMRALPSPDCPGLRTTGEQMQKLLLKENKVKTRKSKRRSGEGSHLTTSILEQ

SEQ ID NO: 805427 - protein, 123 aa, Homo sapiens
PCGGPEDVALAPCTAAAACEAGPSPVYVKVKSAEPADCAEGPVQCKNGLLVSSPHCEEPCAHSCAHPGLPPHLVHKLPLSYLQTQDTGEQMQKLLLKENKVKTRKSKRRSGEGSHLTTSILEQ

SEQ ID NO: 805428 - protein, 175 aa, Homo sapiens; identical to SEQ ID NO: 805426

SEQ ID NO: 805429 - protein, 161 aa, Homo sapiens [sequence omitted]

SEQ ID NO: 805430 - protein, 161 aa, Homo sapiens [sequence omitted]

SEQ ID NO: 805431 - protein, 161 aa, Homo sapiens [sequence omitted]

SEQ ID NO: 805432 - protein, 161 aa, Homo sapiens [sequence omitted]

SEQ ID NO: 805433 - protein, 161 aa, Homo sapiens [sequence omitted]

SEQ ID NO: 805434 - protein, 131 aa, Homo sapiens
MAGILRLVVQWPPGRLQTVTKGVESLICTDWIRHKFTRSRIPEKVFQASPEDHEKYGGDPQNPHKLHIVTRIKSTRRRPYWEKDIIKMLGLEKAHTPQVHKNIPSVNAKLKVVKHLIRFVVSSQLFLKCIA

SEQ ID NO: 805435 - protein, 89 aa, Homo sapiens
VLLPALAQWLQLCSAGPCPQARTSPIILEVLLRLNPRMKLKRVLCASGKWSCDTPGACALFLGTFLSGRDFAGTKMPQFGGRAHCDGRL

SEQ ID NO: 805436 - protein, 110 aa, Homo sapiens
MAGILRLVVQWPPGRLQTVTKGVESLICTDWIRHKFTRSRIPEKVFQASPEDHEKYGGDPQNPHKLHIVTRIKSTRRRPYWEKDIIKMLGLEKIQWHDFSSLRPRPPRLK

SEQ ID NO: 805437 - protein, 161 aa, Homo sapiens [sequence omitted]

SEQ ID NO: 805438 - protein, 373 aa, Homo sapiens
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEKDPTLTCEVLMNAVATEYAAYHQIDNHIHLINPTDETLFPGINSKAKELQTWEWIYGKTPKFSINTSFHVLYEQSHLEIKVFIDIKNGRIEICNIEAPDHWLPLEIRDKLNSSLIGSKFCPTETTMLTNILLRTCPQDHKLNSKWNILCEKIKGIM

SEQ ID NO: 805439 - protein, 405 aa, Homo sapiens
HRAQGLPVARGRMTHFSSSSPHEAVGTTGSRSMLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEKDPTLTCEVLMNAVATEYAAYHQIDNHIHLINPTDETLFPGINSKAKELQTWEWIYGKTPKFSINTSFHVLYEQSHLEIKVFIDIKNGRIEICNIEAPDHWLPLEIRDKLNSSLIGSKFCPTETTMLTNILLRTCPQDHKLNSKWNILCEKIKGIM

SEQ ID NO: 805440 - protein, 289 aa, Homo sapiens
PNGSRPNGSRKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEKDPTLTCEVLMNAVATEYAAYHQIDNHIHLINPTDETLFPGINSKAKELQTWEWIYGKTPKFSINTSFHVLYEQSHLEIKVFIDIKNGRIEICNIEAPDHWLPLEIRDKLNSSLIGSKFCPTETTMLTNILLRTCPQDHKLNSKWNILCEKIKGIM

SEQ ID NO: 805441 - protein, 161 aa, Homo sapiens [sequence omitted]

SEQ ID NO: 805442 - protein, 161 aa, Homo sapiens [sequence omitted]

SEQ ID NO: 805443 - protein, 373 aa, Homo sapiens; identical to SEQ ID NO: 805438

SEQ ID NO: 805444 - protein, 161 aa, Homo sapiens [sequence omitted]

SEQ ID NO: 805445 - protein, 161 aa, Homo sapiens [sequence omitted]

SEQ ID NO: 805446 - protein, 131 aa, Homo sapiens; identical to SEQ ID NO: 805434

SEQ ID NO: 805447 - protein, 161 aa, Homo sapiens [sequence omitted]

SEQ ID NO: 805448 - protein, 134 aa, Homo sapiens
MVRGWVVQAEGSRVPPLKRAITTLMAGILRLVVQWPPGRLQTVTKGVESLICTDWIRHKFTRSRIPEKVFQASPEDHEKYGGDPQNPHKLHIVTRIKSTRRRPYWEKDIIKMLGLEKIQWHDFSSLRPRPPRLK

SEQ ID NO: 805449 - protein, 356 aa, Homo sapiens
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEYAAYHQIDNHIHLINPTDETLFPGINSKAKELQTWEWIYGKTPKFSINTSFHVLYEQSHLEIKVFIDIKNGRIEICNIEAPDHWLPLEIRDKLNSSLIGSKFCPTETTMLTNILLRTCPQDHKLNSKWNILCEKIKGIM

SEQ ID NO: 805450 - protein, 373 aa, Homo sapiens; identical to SEQ ID NO: 805438

SEQ ID NO: 805451 - protein, 190 aa, Homo sapiens
WGDSSRIFNYIRLFQGIRSNATASIPSLVKNLLEKDPTLTCEVLMNAVATEYAAYHQIDNHIHLINPTDETLFPGINSKAKELQTWEWIYGKTPKFSINTSFHVLYEQSHLEIKVFIDIKNGRIEICNIEAPDHWLPLEIRDKLNSSLIGSKFCPTETTMLTNILLRTCPQDHKLNSKWNILCEKIKGIM

SEQ ID NO: 805452 - protein, 319 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSALPAKSPLWPVRGVWPFRPGVWAWP

SEQ ID NO: 805453 - protein, 170 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPDGVLPCCPGQSPTPELEQPTRLGFPKCWDRRREPAQPAGKLELSSVESGSSGARTPPPPQDLSLLLFVVVICQVAFRH

SEQ ID NO: 805454 - protein, 154 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMCECCLQAAQGCGRQTCRWRDPSRRTL

SEQ ID NO: 805455 - protein, 582 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805456 - protein, 373 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPPSQPSRTPGATRTPRAGLPPPRPPPPLKSASA

SEQ ID NO: 805457 - protein, 582 aa, Homo sapiens; identical to SEQ ID NO: 805455

SEQ ID NO: 805458 - protein, 447 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDMSLPDLDSSLASVRRRAGGEGERDQRECSQYRLPPQIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805459 - protein, 605 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKVGAGPEGRRGPHKGRGNCVLFSTLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805460 - protein, 563 aa, Homo sapiens
GPVARWRRPCWAPGLCVRSGRRRGPEGWRGDGVSPALGPSLRPLPPPIPSLLEMDLPVGPGAAAKTSRPSWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805461 - protein, 318 aa, Homo sapiens
MLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805462 - protein, 428 aa, Homo sapiens
MVARPGGWSALENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805463 - protein, 383 aa, Homo sapiens
MKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805464 - protein, 376 aa, Homo sapiens
MDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805465 - protein, 318 aa, Homo sapiens; identical to SEQ ID NO: 805461

SEQ ID NO: 805466 - protein, 373 aa, Homo sapiens
LLLVDSRVSQLWKRGVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805467 - protein, 387 aa, Homo sapiens
LLLVDSRVSQLWKRGVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERVGAASAQPSCPPMRPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805468 - protein, 98 aa, Homo sapiens
PRVPREARVPLEAPEELGQPPTPTPSAGLVLGRQGSLAVLGTGGSAAIAPVGQTGSGLGSTSGQEGHPGLPVCLPPTPCPVVWLGLHSHTWTDPAGCS

SEQ ID NO: 805469 - protein, 582 aa, Homo sapiens; identical to SEQ ID NO: 805455

SEQ ID NO: 805470 - protein, 185 aa, Homo sapiens
MRGGHTVFLPEPAPCVGTGNGSLSRSFRVLHSAWWRKGRGPALGSGAGFAALSGSNSLFSSSTGQLIGRGTGAHVGWRSRPHTHPPTRSSPTTAILSRAQGDASISGPTSPHWGRGRIPPREPTLPSHHQFSRLLMRPLVQSWDPVQGLLKHLPCWAIAAGLGTPGPGPVLGSLIKQSPQQGKAA

SEQ ID NO: 805471 - protein, 596 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERVGAASAQPSCPPMRPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805472 - protein, 373 aa, Homo sapiens; identical to SEQ ID NO: 805456

SEQ ID NO: 805473 - protein, 582 aa, Homo sapiens; identical to SEQ ID NO: 805455

SEQ ID NO: 805474 - protein, 550 aa, Homo sapiens
CGRKEGPRAGLTPSPRQLPGRAAARCAHTAPGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805475 - protein, 464 aa, Homo sapiens
MASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805476 - protein, 435 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPDQHHGGWQEQAPYERRQKGSQEETWLIHFSKKDGYDVKAPAMFNIRNIGKDLVNRTQGTKIGSDGLKGRVFEVSLADLAEL

SEQ ID NO: 805477 - protein, 342 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERRA

SEQ ID NO: 805478 - protein, 417 aa, Homo sapiens
VVGGNFGISVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805479 - protein, 433 aa, Homo sapiens
SCPLGNPSCPPPAPAWGTGRVCGAPSALGLMGLGPTDPAWSVAVRMRLCGGRWPAFGRSMPSNRKSSTRWGQGQRAGGGPTRAGVTVSSLSTLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805480 - protein, 377 aa, Homo sapiens
LAVMVSSVMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805481 - protein, 423 aa, Homo sapiens
AGGEDGGEQRSRRQEQREGAGEGAVSAEQVIAGFNRLRQEQRGLASKAAELEMELNEHSLVIDTLKVDETRKCYRMVGGVLVERTVKEVLPALENNKEQIQKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 805482 - protein, 216 aa, Homo sapiens
GPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKQ

SEQ ID NO: 805483 - protein, 301 aa, Homo sapiens
AWICIRVRGIRAPLVSWGRSRVVGCCLFPLFQRRRTIGSAGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKANACANKLVGSYSVEMGRRARANILLTRLFKGQTSRARHTAREAFQ

SEQ ID NO: 805484 - protein, 328 aa, Homo sapiens
AWICIRVRGIRAPLVSWGRSRVVGCCLFPLFQRRRTIGSAGLNLFWKLCVTVMRLVILDNYDLASEWAAKYICNRIIQFKPGQDRYFTLGLPTGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGLMHVHNKLVDPLFSMKDGN

SEQ ID NO: 805485 - protein, 275 aa, Homo sapiens
AWICIRVRGIRAPLVSWGRSRVVGCCLFPLFQRRRTIGSAGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGLMHVHNKLVDPLFSMKDGN

SEQ ID NO: 805486 - protein, 343 aa, Homo sapiens
AWICIRVRGIRAPLVSWGRSRVVGCCLFPLFQRRRTIGSAGLNLFWKLCVTVMRLVILDNYDLASEWAAKYICNRIIQFKPGQDRYFTLGLPTGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKEMALSYHKLIQENYLLNSVQGCASKARKKFATVWA

SEQ ID NO: 805487 - protein, 328 aa, Homo sapiens; identical to SEQ ID NO: 805484

SEQ ID NO: 805488 - protein, 180 aa, Homo sapiens
AWICIRVRGIRAPLVSWGRSRVVGCCLFPLFQRRRTIGSAGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGLMHVHNKLVDPLFSMKDGN

SEQ ID NO: 805489 - protein, 329 aa, Homo sapiens
AWICIRVRGIRAPLVSWGRSRVVGCCLFPLFQRRRTIGSAGLNLFWKLCVTVMRLVILDNYDLASEWAAKYICNRIIQFKPGQDRYFTLGLPTGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKEMALSYHKLIQENYLLNSVQG

SEQ ID NO: 805490 - protein, 111 aa, Homo sapiens
MSLPKFSSYIYVCIYVIVTGTTVFMCITLLHFTGIICFLQSGGLWQPCMEQVCQHHLSNKTATATPTFKHCLCGVYVFSPHLHRFSLGAAVLATSQRCAREVNWCVFTVPV

SEQ ID NO: 805491 - protein, 411 aa, Homo sapiens [sequence omitted]

SEQ ID NO: 805492 - protein, 111 aa, Homo sapiens; identical to SEQ ID NO: 805490

SEQ ID NO: 805493 - protein, 111 aa, Homo sapiens; identical to SEQ ID NO: 805490

SEQ ID NO: 805494 - protein, 111 aa, Homo sapiens; identical to SEQ ID NO: 805490

SEQ ID NO: 805495 - protein, 111 aa, Homo sapiens; identical to SEQ ID NO: 805490

SEQ ID NO: 805496 - protein, 111 aa, Homo sapiens; identical to SEQ ID NO: 805490

SEQ ID NO: 805497 - protein, 111 aa, Homo sapiens; identical to SEQ ID NO: 805490

SEQ ID NO: 805498 - protein, 111 aa, Homo sapiens; identical to SEQ ID NO: 805490

SEQ ID NO: 805499 - protein, 111 aa, Homo sapiens; identical to SEQ ID NO: 805490

SEQ ID NO: 805500 - protein, 248 aa, Homo sapiens
LDKTRGRRLISVLEQIRHFVMMPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 805501 - protein, 228 aa, Homo sapiens
MMPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 805502 - protein, 111 aa, Homo sapiens; identical to SEQ ID NO: 805490

SEQ ID NO: 805503 - protein, 111 aa, Homo sapiens; identical to SEQ ID NO: 805490

SEQ ID NO: 805504 - protein, 111 aa, Homo sapiens; identical to SEQ ID NO: 805490

SEQ ID NO: 805505 - protein, 111 aa, Homo sapiens; identical to SEQ ID NO: 805490

SEQ ID NO: 805506 - protein, 111 aa, Homo sapiens; identical to SEQ ID NO: 805490

SEQ ID NO: 805507 - protein, 232 aa, Homo sapiens
MELPEFVTRLISVLEQIRHFVMMPEINTNHLDKQQVQLLAEMCILIDENDNKIGAETKKNCHLNENIEKGLLHRAFSVFLFNTGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 805508 - protein, 111 aa, Homo sapiens; identical to SEQ ID NO: 805490

SEQ ID NO: 805509 - protein, 111 aa, Homo sapiens; identical to SEQ ID NO: 805490

SEQ ID NO: 805510 - protein, 111 aa, Homo sapiens; identical to SEQ ID NO: 805490

SEQ ID NO: 805511 - protein, 111 aa, Homo sapiens; identical to SEQ ID NO: 805490

SEQ ID NO: 805512 - protein, 153 aa, Homo sapiens
MIAILVSSYILPPAEAVENPVSENQFLFCHMSIYAKYMYFVPDIGHNAEFTKTHFCAWFDRELRFTRYSVIVLITDYFNCVSNTWIVHYSVISCLTCRFLNSQVIYMCVYMSCNRHNCFHVYHFIALHRYHMFLTKWRFVAALHGASLSAPSF

SEQ ID NO: 805513 - protein, 428 aa, Homo sapiens
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 805514 - protein, 369 aa, Homo sapiens
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 805515 - protein, 428 aa, Homo sapiens; identical to SEQ ID NO: 805513

SEQ ID NO: 805516 - protein, 428 aa, Homo sapiens; identical to SEQ ID NO: 805513

SEQ ID NO: 805517 - protein, 428 aa, Homo sapiens; identical to SEQ ID NO: 805513

SEQ ID NO: 805518 - protein, 272 aa, Homo sapiens
RALAQRQTKGNARLPMAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKDQVPEPEGQLEEPTLEVVEQASPYSMDDRDPRKFFMSGFTGYVPCARFLFGSSFPVLTNQALQEFGQKHSPGSAQDPKHLPPLPRTYPQNLGLLPNYGGYVPGYKFQFGHTFGHLTHDALGLSTFQKQLLA

SEQ ID NO: 805519 - protein, 272 aa, Homo sapiens; identical to SEQ ID NO: 805518

SEQ ID NO: 805520 - protein, 197 aa, Homo sapiens
EPWLKGKQKEMPGSPWLWPAPSYQGSTLRTLIISQGFVPRAQFIFAKNCSQVWAEALSDFTHLHEKDQVPEPEGQLEEPTLEVVEQASPYSMDDRDPRKFFMSGFTGYVPCARFLFGSSFPVLTNQALQEFGQKHSPGSAQDPKHLPPLPRTYPQNLGLLPNYGGYVPGYKFQFGHTFGHLTHDALGLSTFQKQLLA

SEQ ID NO: 805521 - protein, 213 aa, Homo sapiens
RALAQRQTKGNARLPMAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKDQVPEPEGQLEEPTLEVVEQASPYSMDDRDPRKFFMSGTAGIWAEALTRQCPGPQTSPPTSQNIPSEPGSFT

SEQ ID NO: 805522 - protein, 310 aa, Homo sapiens
RALAQRQTKGNARLPMAVASTFIPGLNPQNPHYIPGVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKQGSEELPKEAKGRKDTEKDQVPEPEGQLEEPTLEVVEQASPYSMDDRDPRKFFMSAFLCSPTRHCRNLGRSTHQAVPRTPNISPHFPEHTLRTWVFYLTMGATCQGISSSLATHLAISPMMLWASAPSRSSSWLRPLDIKFPSLFILSQPSFWKGERWVGGWEGGGTQRENGLEAEHLFY

SEQ ID NO: 805523 - protein, 294 aa, Homo sapiens
MAGQGDSGEWESLCCRYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKQGSEELPKEAKGRKDTEKDQVPEPEGQLEEPTLEVVEQASPYSMDDRDPRKFFMSGGELGGQDQRRGEAPGCLGSVSPSSGFTGYVPCARFLFGSSFPVLTNQALQEFGQKHSPGSAQDPKHLPPLPRTYPQNLGLLPNYGGYVPGEKSPRGGFGDWNVCLYGYGVGWVVCGG

SEQ ID NO: 805524 - protein, 253 aa, Homo sapiens
ALAQRQTNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKDQVPEPEGQLEEPTLEVVEQASPYSMDDRDPRKFFMSGFTGYVPCARFLFGSSFPVLTNQALQEFGQKHSPGSAQDPKHLPPLPRTYPQNLGLLPNYGGYVPGYKFQFGHTFGHLTHDALGLSTFQKQLLA

SEQ ID NO: 805525 - protein, 252 aa, Homo sapiens
MAGQGDSGEWESLCCRYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKDQVPEPEGQLEEPTLEVVEQASPYSMDDRDPRKFFMSGFTGYVPCARFLFGSSFPVLTNQALQEFGQKHSPGSAQDPKHLPPLPRTYPQNLGLLPNYGGYVPGYKFQFGHTFGHLTHDALGLSTFQKQLLA

SEQ ID NO: 805526 - protein, 213 aa, Homo sapiens; identical to SEQ ID NO: 805521

SEQ ID NO: 805527 - protein, 296 aa, Homo sapiens
RALAQRQTKGNARLPMAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKDQVPEPEGQLEEPTLEVVEQASPYSMDDRDPRKFFMSGEELGGQDQRRGEAPGCLGSVSPSSGFTGYVPCARFLFGSSFPVLTNQALQEFGQKHSPGSAQDPKHLPPLPRTYPQNLGLLPNYGGYVPGEKSPRGGFGDWNVCLYGYGVGWVVCGG

SEQ ID NO: 805528 - protein, 432 aa, Homo sapiens
MLGNSAPGPATREAGSALLALQQTALQEDQENINPEKAAPVQQPRTRAALAVLKSGNPRGLAQQQRPKTRRVAPLKDLPVNDEHVTVPPWKANSKQPAFTIHVDEAEKEAQKKPAESQKIEREDALAFNSAISLPGPRKPLVPLDYPMDGSFESPHTMDMSIVLEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 805529 - protein, 432 aa, Homo sapiens; identical to SEQ ID NO: 805528

SEQ ID NO: 805530 - protein, 432 aa, Homo sapiens; identical to SEQ ID NO: 805528

SEQ ID NO: 805531 - protein, 432 aa, Homo sapiens; identical to SEQ ID NO: 805528

SEQ ID NO: 805532 - protein, 432 aa, Homo sapiens; identical to SEQ ID NO: 805528

SEQ ID NO: 805533 - protein, 332 aa, Homo sapiens
MASGRSRSRTQKKPAESQKIEREDALAFNSAISLPGPRKPLVPLDYPMDGSFESPHTMDMSIVLEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 805534 - protein, 161 aa, Homo sapiens
MLGNSAPGPATREAGSALLALQQTALQEDQENINPEKAAPVQQPRTRAALAVLKSGNPRGLAQQQRPKTRRVAPLKDLPVNDEHVTVPPWKANSKQPAFTIHVDEAEKEAQKKPAESQKIEREDALAFNSAISLPGPRKPLVPLDYPMDGSFDHTYMDCHV

SEQ ID NO: 805535 - protein, 156 aa, Homo sapiens
MSLLDGLASSPRAPLQSSKARMKKLPKKSQNEKYRLKYLRLRKAAKATVFENAAICDEIARLEEKFLKAKEERRYLLKKLLQLQALTEGEVQAAAPSHSSSLPLTYGVASSVGTIQGAGPISGPSTGAEEPFGKKTKKEKKEKGKENNKLEAPKWF

SEQ ID NO: 805536 - protein, 204 aa, Homo sapiens
MSLLDGLASSPRAPLQSSKARMKKLPKKSQNEKYRLKYLRLRKAAKATVFENAAICDEIARLEEKFLKAKEERRYLLKKLLQLQALTEGEVQAAAPSHSSSLPLTYGVASSVGTIQGAGPISGPSTGAEEPFGKKTKKEKKEKGKENNKLEVLKKTCKKKKMAGGARKLVQPIALDPSGRPVFPIGLGGLTVYSLGEVSETSDI

SEQ ID NO: 805537 - protein, 187 aa, Homo sapiens
MKCPDQKCLYTCQIKDGGVQPQFEIVPEDDPQNAIVSSSADACHAELLRTISTTMGKLMPNLLPAGADFFGFSHPAIHNLIQSCPGARKCINYQWVKFDVCKPGDGQLPEGLPENDAAMSFEAFQRQIFDEDQNDPLLPGSLDLPELQPAAFVSSYQPMYLTHEPLVDTHLQHLKSPSQGSPIQSSD

SEQ ID NO: 805538 - protein, 123 aa, Homo sapiens
MSLLDGLASSPRAPLQSSKARMKKLPKKSQNEKYRLKYLRLRKAAKATVFVSLTHVQPVPSWRLPHKIFPQAVPPSQCDSINTVLAFPYTLLLVSLVSLDKLRNFSVSSSVNELVTVLQNNEY

SEQ ID NO: 805539 - protein, 187 aa, Homo sapiens; identical to SEQ ID NO: 805537

SEQ ID NO: 805540 - protein, 156 aa, Homo sapiens; identical to SEQ ID NO: 805535

SEQ ID NO: 805541 - protein, 260 aa, Homo sapiens
MVWPALWELYRELGLFQGPALGLRNHLGRKLRRRKKKKAKRTTNWKIITDRPGFHDESAIYPVGYCSTRIYASMKCPDQKCLYTCQIKDGGVQPQFEIVPEDDPQNAIVSSSADACHAELLRTISTTMGKLMPNLLPAGADFFGFSHPAIHNLIQSCPGARKCINYQWVKFDVCKPGDGQLPEGLPENDAAMSFEAFQRQIFDEDQNDPLLPGSLDLPELQPAAFVSSYQPMYLTHEPLVDTHLQHLKSPSQGSPIQSSD

SEQ ID NO: 805542 - protein, 411 aa, Homo sapiens
MSLLDGLASSPRAPLQSSKARMKKLPKKSQNEKYRLKYLRLRKAAKATVFENAAICDEIARLEEKFLKAKEERRYLLKKLLQLQALTEGEVQAAAPSHSSSLPLTYGVASSVGTIQGAGPISGPSTGAEEPFGKKTKKEKKEKGKENNKLEVLKKTCKKKKMAGGARKLVQPIALDPSGRPVFPIGLGGLTVYSLGEIITDRPGFHDESAIYPVGYCSTRIYASMKCPDQKCLYTCQIKDGGVQPQFEIVPEDDPQNAIVSSSADACHAELLRTISTTMGKLMPNLLPAGADFFGFSHPAIHNLIQSCPGARKCINYQWVKFDVCKPGDGQLPEGLPENDAAMSFEAFQRQIFDEDQNDPLLPGSLDLPELQPAAFVSSYQPMYLTHEPLVDTHLQHLKSPSQGSPIQSSD

SEQ ID NO: 805543 - protein, 384 aa, Homo sapiens
MSLLDGLASSPRAPLQSSKARMKKLPKKSQNEKYRLKYLRLRKAAKATVFENAAICDEIARLEEKFLKAKEERRYLLKKLLQLQALTEGEVQAAAPSHSSSLPLTYGVASSVGTIQGAGPISGPSTGAEEPFGKKTKKEKKEKGKENNKLEAAASVLIHTNPSVSPVPAKIITDRPGFHDESAIYPVGYCSTRIYASMKCPDQKCLYTCQIKDGGVQPQFEIVPEDDPQNAIVSSSADACHAELLRTISTTMGKLMPNLLPAGADFFGFSHPAIHNLIQSCPGARKCINYQWVKFDVCKPGDGQLPEGLPENDAAMSFEAFQRQIFDEDQNDPLLPGSLDLPELQPAAFVSSYQPMYLTHEPLVDTHLQHLKSPSQGSPIQSSD

SEQ ID NO: 805544 - protein, 187 aa, Homo sapiens; identical to SEQ ID NO: 805537

SEQ ID NO: 805545 - protein, 187 aa, Homo sapiens; identical to SEQ ID NO: 805537

SEQ ID NO: 805546 - protein, 260 aa, Homo sapiens; identical to SEQ ID NO: 805541

SEQ ID NO: 805547 - protein, 935 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805548 - protein, 926 aa, Homo sapiens
PPTTTKFAAASTPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805549 - protein, 947 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKELIENGSPKRQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805550 - protein, 932 aa, Homo sapiens
MKRWIEQDMDIIKEFNRSTERPDEEMDRRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805551 - protein, 751 aa, Homo sapiens
MKIRHFLSYREPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805552 - protein, 922 aa, Homo sapiens
AGGGSGGALRRRCAQAALPEMPRGSRARGSKRKRSWNTECPSFPGERPLQVRRAGLRTAGAAASLSEAWLSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805553 - protein, 757 aa, Homo sapiens
DIDVVIQKSRAEDCLFEPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805554 - protein, 604 aa, Homo sapiens
MQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805555 - protein, 913 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGRSRDQEPWQKSSFLHLVSFWLRATK

SEQ ID NO: 805556 - protein, 750 aa, Homo sapiens
AGGGSGGALRRRCAQAALPEMPRGSRARGSKRKRSWNTECPSFPGERPLQVRRAGLRTAGAAASLSEAWLSLTAEEKTITEKHLELCPRPKQETTTSKSTSGLTDITWSSSGSDLSDEDKTLSQLQRGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805557 - protein, 875 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGVLCVSTALMQGRLIRAHRIPLVASGCLLVAWTLPAPSRSPSQTWPMYQPPAFTDPVAATWAEPAPWRCCAHSRIACWWHPILLQTPQTNQKLEYYKCVYLDQPAPFSRDQTKILPQLSFLIFIES

SEQ ID NO: 805558 - protein, 390 aa, Homo sapiens
MFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805559 - protein, 276 aa, Homo sapiens [sequence omitted]

SEQ ID NO: 805560 - protein, 276 aa, Homo sapiens [sequence omitted]

SEQ ID NO: 805561 - protein, 935 aa, Homo sapiens; identical to SEQ ID NO: 805547

SEQ ID NO: 805562 - protein, 832 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDR

SEQ ID NO: 805563 - protein, 232 aa, Homo sapiens
MKRWIEQDMDIIKEFNRSTERPDEEMDRRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKVRMKYFKTFIHFITFANHSCHFFFCFFFSCPSSRTTTFDS

SEQ ID NO: 805564 - protein, 192 aa, Homo sapiens
PPTTTKFAAASTPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKVENLVY

SEQ ID NO: 805565 - protein, 875 aa, Homo sapiens; identical to SEQ ID NO: 805557

SEQ ID NO: 805566 - protein, 835 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRATK

SEQ ID NO: 805567 - protein, 975 aa, Homo sapiens
MNSQMKRWIEQDMDIIKEFKEAHERPDEEMDRRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKVLAIMIEGAINIHLEVSVWRYTFNSFEYDTKQSNYWIVLPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805568 - protein, 696 aa, Homo sapiens
MERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805569 - protein, 851 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKRWTSRKTKWTAESREICYFFVETSMYFLPKDTFSRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805570 - protein, 903 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKVGARPEHARTPSSLQHSEAVAAQHFLPAEVCRR

SEQ ID NO: 805571 - protein, 875 aa, Homo sapiens; identical to SEQ ID NO: 805557

SEQ ID NO: 805572 - protein, 409 aa, Homo sapiens
MGKGHSVSRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805573 - protein, 469 aa, Homo sapiens
MTVRDFTQVFDSYAQFEESMIAAKMETASELGREEEDDVDLELRLAPEDDVHHLQRGASSGHTAPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805574 - protein, 342 aa, Homo sapiens
SYEVRASVLQAAGLNCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 805575 - protein, 934 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGVSAGGPAQGAAHSVACMSNSSPEEAPTPKCVLLQPIPLGSGVDTRE

SEQ ID NO: 805576 - protein, 597 aa, Homo sapiens
AGGGSGGALRRRCAQAALPEMPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRQRGFSVDRATGSSRP

SEQ ID NO: 805577 - protein, 211 aa, Homo sapiens
DSDLGISYHFSINKSPITAVPRPRSRPQTHSQFLDQHHLPGTPSQLPPIPPPPPPLPPLTAPARPRLPAPPSHHRACVLTPFRRDQSRQRARGPSSAQFRAPPRAHEASTAVAQPAEERAASTAAAQARRAHSCLLTRAPPFSFGPSGRLGSLRFPTGISHFTKKVGFLLLANSTSRAQSYVRSTVYIKTVQDKNWPLHSALTAVFKAGAW

SEQ ID NO: 805578 - protein, 105 aa, Homo sapiens
MECLQGPSASIWAWGFPMSAQRLVMWQRGRAAPPRTSTLRSPHLACVWLSLPGSPLSLHGKHYGPELSKAHSHVFFSIFFSQKYSLYKDCPGQKLATPFSIDSSI

SEQ ID NO: 805579 - protein, 165 aa, Homo sapiens
DSDLGISYHFSINKSPITAVPRPRSRPQTHSQFLDQHHLPGTPSQLPPIPPPPPPLPPLTAPARPRLPAPPSHHRACVLTPFRRDQSRQRARGPSSAQFRAPPRAHEASTAVAQPAEERAASTAAAQARRAHSCLLTRAPPFSFGPSGRLGSLRFPDKNGRMKEL

SEQ ID NO: 805580 - protein, 179 aa, Homo sapiens
DSDLGISYHFSINKSPITAVPRPRSRPQTHSQFLDQHHLPGTPSQLPPIPPPPPPLPPLTAPARPRLPAPPSHHRACVLTPFRRDQSRQRARGPSSAQFRAPPRAHEASTAVAQPAEERAASTAAAQARRAHSCLLTRAPPFSFGPSGRLGSLRFPKYSLYKDCPGQKLATPFSIDSSI

SEQ ID NO: 805581 - protein, 165 aa, Homo sapiens; identical to SEQ ID NO: 805579

SEQ ID NO: 805582 - protein, 165 aa, Homo sapiens; identical to SEQ ID NO: 805579

SEQ ID NO: 805583 - protein, 221 aa, Homo sapiens
GGKRRLRRVSGVSPSPCGPFKGRGRVAGPPPPRGARSPLSASPGAGAGSGRGPAAVWERRVMYTITKGPSKLVAQRRTGPTQQQVEGRLGELLKCRQPAPPTSQPPRAQPFAQPPGPWPLSSPGPRLVFNRVNGRRAPSTSPSFEGTQETYTVAHEENVRFVSEAWQQVQQQLDGGPAGEGGPRPVQYVERTPNPRLQNFVPIDLDEWWAQQFLARITSCS

SEQ ID NO: 805584 - protein, 480 aa, Homo sapiens
REPSPLASPLVSGRWGVGEGYSHSPDSGTAHPGTQSSSHGTWGQPGRGQRPPFPSRSIRPWRETSWRWRCFCGARMWPRTTPRVGGLGQRDMVMDWVVAQVRIWAADGMQVAAWAPARPSGRGTEWGPTKGLGHSKTEAPTLQSLTSLRTQGCRCELSCRWLGDCKRGLGHRLLWVAALSGSGSAQAGQVWGKWAGPGLLLSSARQHRPGMGTNHVRLLPSCSPGPRLVFNRVNGRRAPSTSPSFEGTQETYTVAHEENVRFVSEGSERGQRVRHRLLGRKTMDPGWPHFKLTHSRCMAVLFLGTLPLCPVTSPVWELESRVTIRPWVGDGVPGTWLSPTALLPQPGSRCNSSWMVAQPVRAGQGLCSTWRGPPIPGCRVSPPTLSPQERPPSPSDPDPGPARFPPQGMREGTLVQKPLLPSACRTRSPGERLVVSSRGDLPAGLGGSITAQPSLPTDFVPIDLDEWWAQQFLARITSCS

SEQ ID NO: 805585 - protein, 135 aa, Homo sapiens
GGKRRLRRVSGVSPSPCGPFKGRGRVAGPPPPRGARSPLSASPGAGAGSGRGPAAVWERRVMYTITKGPSKLVAQRRTAWQQVQQQLDGGPAGEGGPRPVQYVERTPNPRLQNFVPIDLDEWWAQQFLARITSCS

SEQ ID NO: 805586 - protein, 191 aa, Homo sapiens
GGKRRLRRVSGVSPSPCGPFKGRGRVAGPPPPRGARSPLSASPGAGAGSGRGPAAVWERRVMYTITKGPSKLVAQRRTGPTQQQVEGRLGELLKCRQPAPPTSQPPRAQPFAQPPGPWPLSSPGPRLVFNRVNGRRAPSTSPSFEGTQETYTVAHEENVRFVSEAWQQVQQQLDGGPAGEGGPRPVQLCAH

SEQ ID NO: 805587 - protein, 221 aa, Homo sapiens; identical to SEQ ID NO: 805583

SEQ ID NO: 805588 - protein, 221 aa, Homo sapiens; identical to SEQ ID NO: 805583

SEQ ID NO: 805589 - protein, 123 aa, Homo sapiens
GGKRRLRRVSGVSPSPCGPFKGRGRVAGPPPPRGARSPLSASPGAGAGSGRGPAAVWERRVMYTITKGPSKLVAQRRTVPLSAEEEPRAALGHLSPGRQQAGRDRECLAEQAQPRTPGSHLRL

SEQ ID NO: 805590 - protein, 126 aa, Homo sapiens
GGKRRLRRVSGVSPSPCGPFKGRGRVAGPPPPRGARSPLSASPGAGAGSGRGPAAVWERRVMYTITKGPSKLVAQRRTGPTQQQVEGRLGELLKCRQPAPPTSQPPRAQPFAQPPGPWPLSSAPLS

SEQ ID NO: 805591 - protein, 242 aa, Homo sapiens
GGKRRLRRVSGVSPSPCGPFKGRGRVAGPPPPRGARSPLSASPGAGAGSGRGPAAVWERRVMYTITKGPSKLVAQRRTGPTQQQVEGRLGELLKCRQPAPPTSQPPRAQPFAQPPGPWPLSSPGPRLVFNRVNGRRAPSTSPSFEGTQETYTVAHEENVRFVSEAWQQVQQQLDGGPAGEGGPRPVQYVERTPNPRLQSPAHPLRLAGCRPHLKCQHLDFCTFFSLGPAVPTKLPWPRAEPV

SEQ ID NO: 805592 - protein, 221 aa, Homo sapiens; identical to SEQ ID NO: 805583

SEQ ID NO: 805593 - protein, 136 aa, Homo sapiens
GGKRRLRRVSGVSPSPCGPFKGRGRVAGPPPPRGARSPLSASPGAGAGSGRGPAAVWERRVMYTITKGPSKLVAQRRTGPTQQQVEGRLGELLKCRQPAPPTSQPPRAQPFAQPPGPWPLSSLAAGATAAGWWPSR

SEQ ID NO: 805594 - protein, 161 aa, Homo sapiens
GGKRRLRRVSGVSPSPCGPFKGRGRVAGPPPPRGARSPLSASPGAGAGSGRGPAAVWERRVMYTITKGPSKLVAQRRTGAHGPGNGNGDGAGRGGGDRPPVPAGPTQQQVEGRLGELLKCRQPAPPTSQPPRAQPFAQPPGPWPLSSLAAGATAAGWWPSR

SEQ ID NO: 805595 - protein, 136 aa, Homo sapiens; identical to SEQ ID NO: 805593

SEQ ID NO: 805596 - protein, 126 aa, Homo sapiens; identical to SEQ ID NO: 805590

SEQ ID NO: 805597 - protein, 151 aa, Homo sapiens
GGKRRLRRVSGVSPSPCGPFKGRGRVAGPPPPRGARSPLSASPGAGAGSGRGPAAVWERRVMYTITKGPSKLVAQRRTGAHGPGNGNGDGAGRGGGDRPPVPAGPTQQQVEGRLGELLKCRQPAPPTSQPPRAQPFAQPPGPWPLSSAPLS

SEQ ID NO: 805598 - protein, 167 aa, Homo sapiens
MAGGPPPRPHPSRGPRRPTQWPTRRMSALCPKPGSRCNSSWMVAQPVRAGQGLCSTWRGPPIPGCRVSPPTLSPQERPPSPSDPDPGPARFPPQGMREGTLVQKPLLPSACRTRSPGERLVVSSRGDLPAGLGGSITAQPSLPTDFVPIDLDEWWAQQFLARITSCS

SEQ ID NO: 805599 - protein, 380 aa, Homo sapiens
MRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 805600 - protein, 132 aa, Homo sapiens
RVCQIPPSCPARLPSPRTLSVSKERVSDTLKERSWNSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 805601 - protein, 411 aa, Homo sapiens
CQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 805602 - protein, 411 aa, Homo sapiens; identical to SEQ ID NO: 805601

SEQ ID NO: 805603 - protein, 394 aa, Homo sapiens
CQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNCWEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 805604 - protein, 117 aa, Homo sapiens
CQGSGDDNLTSLGTLNFPGRTVFSNGYSSPSMRPDVSSPPSSSSTATTGPPPKLCLVCSDEASGCHYGVLTCGSCKVFFKRAVEGSVCFEEFIFPLLGFHFSGWILKFPLYAKPMKG

SEQ ID NO: 805605 - protein, 67 aa, Homo sapiens
CMVPELSLQDSSGSERTGHRGKARMSHTPTPCRELGHRPAGPGSDGKQKLIMTRNCFPTESTWRWQC

SEQ ID NO: 805606 - protein, 110 aa, Homo sapiens
LAPRRQTVGSLLGLPQTLRSNLKLFTVDVLYCPEAIVSLVGVLRRLAACQEHKRAPEVYVAFTVRNPETCQLFTTELGWAGIRWEAEAHHDQKLFPYGEHLEMAMLNLTL

SEQ ID NO: 805607 - protein, 198 aa, Homo sapiens
RRAHCAPSPGMWAAGRAERPAGLAGVQGQTGWVSVLKPPALRLHCEASCVCVKHPPSVKYARCFLSELIKKPSGGSVTISESTAIISHGTTGLVTWDATLSLQNGPSRTQQPSLTDVLYCPEAIVSLVGVLRRLAACQEHKRAPEVYVAFTVRNPETCQLFTTELGWAGIRWEAEAHHDQKLFPYGEHLEMAMLNLTL

SEQ ID NO: 805608 - protein, 102 aa, Homo sapiens
AAAERILDGGPQFTPQARRKWWKAQLWVILGAAPVTRYQEEGLLTFRLSVARSYSNTRMAGLLAPLTTPEHPKAVGVVVPEELPCYDAMMLPDHLQMRKLSE

SEQ ID NO: 805609 - protein, 222 aa, Homo sapiens
MECPVMETGSLFTSGIKRHLKDKRISKTTKLNVSLASKIKTKILNNSSIFKISLKHNNRALAQALSREKENSRRITTEKMLLQKEVEKLNFENTFLRLKLNNLNKKLIDIEALMNNNLITAIEMSSLSEFHQSSFLLSASKKKRISKQCKLMRLPFARVPLTSNDDEDEDKEKMQCDNHIKSKTLPDIPSSGSTTQPLSTQDNRKCFFQQSPRFGRFTIPLG

SEQ ID NO: 805610 - protein, 196 aa, Homo sapiens
MECPVMETGSLFTSGIKRHLKDKRISKTTKLNVSLASKIKTKILNNSSIFKISLKHNNRALAQALSREKENSRRITTEKMLLQKEVEKLNFENTFLRLKLNNLNKKLIDIEALMNNNLITAIEMSSLSEFHQSSFLLSASKKKRISKQCKLMRLPFASRTWWLMPVIPALWEAEAGGSRGQEIETILANMVKPRLY

SEQ ID NO: 805611 - protein, 658 aa, Homo sapiens
MGGHLSPWPTYTSGQTILQNRKPCSDDYRKRVGSCQQHPFRTAKPQYLEELENYLRKELLLLDLGTDSTQELRLQPYREIFEFFIEDFKTYKPLLSSIKNAYEGMLAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQLDTLRASYEEVRKEHEILMQLHMSTLKERDQFFSELQEIQRTSTPRPDWTKCKDVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 805612 - protein, 764 aa, Homo sapiens
MACQQSRYHSFSSASRLQPRPSGVTIDESFLTEDKSTQNRKLLQKRRTLTGQFSMGGHLSPWPTYTSGQTILQNRKPCSDDYRKRVGSCQQHPFRTAKPQYLEELENYLRKELLLLDLGTDSTQELRLQPYREIFEFFIEDFKTYKPLLSSIKNAYEGMLAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQVLAGRQGQEGEDGVSQVGGQGQCPCPQLDTLRASYEEVRKEHEILMQLHMSTLKERDQFFSELQEIQRTSTPRPDWTKCKGEGSRQGPRSCLHVGPDSSSLSPHADVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 805613 - protein, 653 aa, Homo sapiens
MACQQSRYHSFSSASRLQPRPSGVTIDESFLTEDKSTQNRKLLQKRRTLTGQFSMGGHLSPWPTYTSGQTILQNRKPCSDDYRKRVGSCQQHPFRTAKPQYLEELENYLRKELLLLDLGTDSTQELRLQPYREIFEFFIEDFKTYKPLLSSIKNAYEGMLAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQVLAGRQGQEGEDGVSQVGGQGQCPCPQLDTLRASYEEVRKEHEILMQLHMSTLKERDQFFSELQEIQRTSTPRPDWTKCKGEGSRQGPRSCLHVGPDSSSLSPHADVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLKPLGLPVHHAPSTAQPSTEEGTWESGARRGGGQGLSLSFLWGSHEEVTLPKLRGGLMTIDPSLDKQTVNTYMSQAFQLPESEMPEEGDEKEEAVVEILQTALERLQVIDIRRVGPREPEPAS

SEQ ID NO: 805614 - protein, 574 aa, Homo sapiens
MRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQVLAGRQGQEGEDGVSQVGGQGQCPCPQLDTLRASYEEVRKEHEILMQLHMSTLKERDQFFSELQEIQRTSTPRPDWTKCKGEGSRQGPRSCLHVGPDSSSLSPHADVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 805615 - protein, 117 aa, Homo sapiens
MEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 805616 - protein, 686 aa, Homo sapiens
MACQQSRYHSFSSASRLQPRPSGVTIDESFLTEDKSTQNRKLLQKRRTLTGQFSMGGHLSPWPTYTSGQTILQNRKPCSDDYRKRVGSCQQHPFRTAKPQYLEELENYLRKELLLLDLGTDSTQELRLQPYREIFEFFIEDFKTYKPLLSSIKNAYEGMLAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQVLAGRQGQEGEDGVSQVGGQGQCPCPQLDTLRASYEEVRKEHEILMQLHMSTLKERDQFFSELQEIQRTSTPRPDWTKCKGEGSRQGPRSCLHVGPDSSSLSPHADVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLKPLGLPVHHAPSTAQPSTEEGTWESGARRGGGQGLSLSFLWGSHEEVTLPKLRGGLMTIDPSLDKQTVNTYMSQAFQLPESEMPEEGDEKEEAVVEILQTALERLQRGELSPKASRGKPNLTWRSQGSISQIPQKGTHVYSSAGWRSAGQARPLH

SEQ ID NO: 805617 - protein, 76 aa, Homo sapiens
MGPPRTQPTPWGDQLHTGVQGQPLTTQPPSCQVTKLRKNLAEEYLHYLSERDACKILIADLNELRYQREDMSLAQS

SEQ ID NO: 805618 - protein, 670 aa, Homo sapiens
MACQQSRYHSFSSASRLQPRPSGVTIDESFLTEDKSTQNRKLLQKRRTLELPAAPLSHCQAPVLGGTGKLPTQGAPPAGPGHRFHPGTKAAAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQVLAGRQGQEGEDGVSQVGGQGQCPCPQLDTLRASYEEVRKEHEILMQLHMSTLKERDQFFSELQEIQRTSTPRPDWTKCKDVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 805619 - protein, 101 aa, Homo sapiens
REGGELGNSAPTTDPGPVRLGHGVDLLQLGPLGGLMTIDPSLDKQTVNTYMSQAFQLPESEMPEEGDEKEEAVVEILQTALERLQVIDIRRVGPREPEPAS

SEQ ID NO: 805620 - protein, 587 aa, Homo sapiens
MACQQSRYHSFSSASRLQPRPSGVTIDESFLTEDKSTQNRKLLQKRRTLVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQVLAGRQGQEGEDGVSQVGGQGQCPCPQLDTLRASYEEVRKEHEILMQLHMSTLKERDQFFSELQEIQRTSTPRPDWTKCKGEGSRQGPRSCLHVGPDSSSLSPHADVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 805621 - protein, 676 aa, Homo sapiens
MATGCTLPQLPRPRVLIARLPVGHGLPAVAVPQLLVRVEITATAFRSDHRRILSHRRQEHPESQASSETKDAAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQVLAGRQGQEGEDGVSQVGGQGQCPCPQLDTLRASYEEVRKEHEILMQLHMSTLKERDQFFSELQEIQRTSTPRPDWTKCKGEGSRQGPRSCLHVGPDSSSLSPHADVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 805622 - protein, 797 aa, Homo sapiens
MACQQSRYHSFSSASRLQPRPSGVTIDESFLTEDKSTQNRKLLQKRRTLTGQFSMGGHLSPWPTYTSGQTILQNRKPCSDDYRKRVGSCQQHPFRTAKPQYLEELENYLRKELLLLDLGTDSTQELRLQPYREIFEFFIEDFKTYKPLLSSIKNAYEGMLAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQVLAGRQGQEGEDGVSQVGGQGQCPCPQLDTLRASYEEVRKEHEILMQLHMSTLKERDQFFSELQEIQRTSTPRPDWTKCKGEGSRQGPRSCLHVGPDSSSLSPHADVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQRGELSPKASRGKPNLTWRSQGSISQIPQKGTHVYSSAGWRSAGQARPLH

SEQ ID NO: 805623 - protein, 162 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQIKQETGSLAKICCHVRR

SEQ ID NO: 805624 - protein, 427 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 805625 - protein, 337 aa, Homo sapiens
MGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 805626 - protein, 398 aa, Homo sapiens
CSRSDSRGPQAEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 805627 - protein, 403 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARILQLLCHFSS

SEQ ID NO: 805628 - protein, 113 aa, Homo sapiens
SRDGFWSKNRLSAPITPRDSPIFTARFYFQGLGVIILMSVTGGGNQILFVCLWNYPEVKGVNDVEEKEGITVPSLKRQLEMGSRVKWREPGKIPLNWTRSLKEEKWLSKQGTN

SEQ ID NO: 805629 - protein, 427 aa, Homo sapiens; identical to SEQ ID NO: 805624

SEQ ID NO: 805630 - protein, 427 aa, Homo sapiens; identical to SEQ ID NO: 805624

SEQ ID NO: 805631 - protein, 427 aa, Homo sapiens; identical to SEQ ID NO: 805624

SEQ ID NO: 805632 - protein, 132 aa, Homo sapiens
MTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 805633 - protein, 339 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVRTK

SEQ ID NO: 805634 - protein, 95 aa, Homo sapiens
TAVCGDLRIPCCNWDAKKGEYVFPAKKKLQEYRVLITTLITAGRFVLKNTQCIPEGLESYYAEQDSSAREKFYTVISHYNLAKQSITRSVSSRIC

SEQ ID NO: 805635 - protein, 1044 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 805636 - protein, 1003 aa, Homo sapiens
MPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 805637 - protein, 1063 aa, Homo sapiens
MSFSVFPQSFQSAACDWAFPLRNEQSRTHCLKQLYFALGSPIAFPENIKHSSDPQPESLCLWAPSCSTAGLVCPAQSDPPMPFPTRRPASLSPAFPHFPVSSASGSFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 805638 - protein, 941 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVRSSVTSKGGAPPPDGTSLISRPLGRGSRSLGLCWLRISEEHQGQLPPPFVPQLPGLLPGSLLH

SEQ ID NO: 805639 - protein, 888 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQLPGLLPGSLLH

SEQ ID NO: 805640 - protein, 888 aa, Homo sapiens; identical to SEQ ID NO: 805639

SEQ ID NO: 805641 - protein, 888 aa, Homo sapiens; identical to SEQ ID NO: 805639

SEQ ID NO: 805642 - protein, 977 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVTCCSTVTPCLPCAPTCPLPETSSSFHSSPRPRPTPAALNRARALPEPLTPGDSNLRVWDGIRKPACLTNTSCHS

SEQ ID NO: 805643 - protein, 888 aa, Homo sapiens; identical to SEQ ID NO: 805639

SEQ ID NO: 805644 - protein, 818 aa, Homo sapiens
MWSPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 805645 - protein, 860 aa, Homo sapiens
SSVPFGLPSGGSGFTGARRKAVFFLPPWGRCHSSQPGPTKDFEFPGSASCECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 805646 - protein, 870 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAPSCIRLMAREKGTCPLLPGGENPLLHHQT

SEQ ID NO: 805647 - protein, 573 aa, Homo sapiens
MSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 805648 - protein, 974 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKV

SEQ ID NO: 805649 - protein, 888 aa, Homo sapiens; identical to SEQ ID NO: 805639

SEQ ID NO: 805650 - protein, 1034 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGPHSHDYLPQEREGEGGLSLQVEPEWRNEL

SEQ ID NO: 805651 - protein, 888 aa, Homo sapiens; identical to SEQ ID NO: 805639

SEQ ID NO: 805652 - protein, 280 aa, Homo sapiens
SVLLSREPAGSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 805653 - protein, 604 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPALTACLTLNQNPAELPLQGTGRLGEGVYNPSHSTPSPAGENDTSSC

SEQ ID NO: 805654 - protein, 455 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVRAQIECEEGGLKPAKLEAVGRTIPDSRAEQEES

SEQ ID NO: 805655 - protein, 182 aa, Homo sapiens
MRRGGGDRTKKPKGKLRLPAAAATFSFISTDPPAWAAAAAAMPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVAIPWPPFQPPNGQLP

SEQ ID NO: 805656 - protein, 77 aa, Homo sapiens
DTRRPPVWECNLTITTPEGLKASQSRAGQTDGRTTDMRMCPRLCAEDRDALRQLQPSRPGPGECTLDHGSKLFFRRL

SEQ ID NO: 805657 - protein, 1267 aa, Homo sapiens
MPDSNSSLLAIGLHDLGARTEHGFSFEKSLAIVDEELEGTLAQGELNEMRTRLYLNLGLTFESLQQTALCNDYFRKSIFLAEQNHLYEDLFRARYNLGTIHWRAGQHSQAMRCLEGARECAHTMRKRFMESECCVVIAQVLQDLGDFLAAKRALKKAYRLGSQKPVQRAAICQNLQHVLAVVRLQQQLEEAEGRDPQGAMVICEQLGDLFSKAGDFPRAAEAYQKQLRFAELLDRPGAERAIIHVSLATTLGDMKDHHGAVRHYEEELRLRSGNVLEEAKTWLNIALSREEAGDAYELLAPCFQKALSCAQQAQRPQLQRQVLQHLHTVQLRLQPQEAPETETRLRELSVAEDEDEEEEAEEAAATAESEALEAGEVELSESEDDTDGLTPQLEEDEELQGHLGRRKGSKWNRRNDMGETLLHRACIEGQLRRVQDLVRQGHPLNPRDYCGWTPLHEACNYGHLEIVRFLLDHGAAVDDPGGQGCEGITPLHDALNCGHFEVAELLLERGASVTLRTRKGLSPLETLQQWVKLYRRDLDLETRQKARAMEMLLQAAASGQDPHSSQAFHTPSSLLFDPETSPPLSPCPEPPSNSTRLPEASQAHVRVSPGQAAPAMARPRRSRHGPASSSSSSEGEDSAGPARPSQKRPRCSATAQRVAAWTPGPASNREAATASTSRAAYQAAIRGVGSAQSRLGPGPPRGHSKALAPQAALIPEEECLAGDWLELDMPLTRSRRPRPRGTGDNRRPSSTSGSDSEESRPRARAKQVRLTCMQSCSAPVNAGPSSLASEPPGSPSTPRVSEPSGDSSAAGQPLGPAPPPPIRVRVQVQDHLFLIPVPHSSDTHSVAWLAEQAAQRYYQTCGLLPRLTLRKEGALLAPQDLIPDVLQSNDEVLAEVTSWDLPPLTDRYRRACQSLGQGEHQQVLQAVELQGLGLSFSACSLALDQAQLTPLLRALKLHTALRELRLAGNRLGDKCVAELVAALGTMPSLALLDLSSNHLGPEGLRQLAMGLPGQATLQSLEELDLSMNPLGDGCGQSLASLLHACPLLSTLRLQACGFGPSFFLSHQTALGSAFQDAEHLKTLSLSYNALGAPALARTLQSLPAGTLLHLELSSVAAGKGDSDLMEPVFRYLAKEGCALAHLTLSANHLGDKAVRDLCRCLSLCPSLISLDLSANPEISCASLEELLSTLQKRPQGLSFLGLSGCAVQGPLGLGLWDKIAAQLRELQLCSRRLCAEDRDALRQLQPSRPGPGECTLDHGSKLFFRRL

SEQ ID NO: 805658 - protein, 775 aa, Homo sapiens
MPSTVATSRWLSCCLNGGRPSPSALERGLSPLETLQQWVKLYRRDLDLETRQKARAMEMLLQAAASGQDPHSSQAFHTPSSLLFDPETSPPLSPCPEPPSNSTRLPEASQAHVRVSPGQAAPAMARPRRSRHGPASSSSSSEGEDSAGPARPSQKRPRCSATAQRVAAWTPGPASNREAATASTSRAAYQAAIRGVGSAQSRLGPGPPRGHSKALAPQAALIPEEECLAGDWLELDMPLTRSRRPRPRGTGDNRRPSSTSGSDSEESRPRARAKQVRLTCMQSCSAPVNAGPSSLASEPPGSPSTPRVSEPSGDSSAAGQPLGPAPPPPIRVRVQVQDHLFLIPVPHSSDTHSVAWLAEQAAQRYYQTCGLLPRLTLRKEGALLAPQDLIPDVLQSNDEVLAEVTSWDLPPLTDRYRRACQSLGQGEHQQVLQAVELQGLGLSFSACSLALDQAQLTPLLRALKLHTALRELRLAGNRLGDKCVAELVAALGTMPSLALLDLSSNHLGPEGLRQLAMGLPGQATLQSLEELDLSMNPLGDGCGQSLASLLHACPLLSTLRLQACGFGPSFFLSHQTALGSAFQDAEHLKTLSLSYNALGAPALARTLQSLPAGTLLHLELSSVAAGKGDSDLMEPVFRYLAKEGCALAHLTLSANHLGDKAVRDLCRCLSLCPSLISLDLSANPEISCASLEELLSTLQKRPQGLSFLGLSGCAVQGPLGLGLWDKIAAQLRELQLCSRRLCAEDRDALRQLQPSRPGPGECTLDHGSKLFFRRL

SEQ ID NO: 805659 - protein, 624 aa, Homo sapiens
HEGELRQLSKAKAKAQRAGQRREEAALCHQLGELLAGHGRYAEALEQHWQELQLRERADDPLGCAVAHRKIGERLAEMEDYPAALQHQHQYLELAHSLRNHTELQRAWATIGRTHLDIYDHCQSRDALLQAQAAFEKSLAIVDEELEGTLAQGELNEMRTRLYLNLGLTFESLQQTALCNDYFRKSIFLAEQNHLYEDLFRARYNLGTIHWRAGQHSQAMRCLEGARECAHTMRKRFMESECCVVIAQVLQDLGDFLAAKRALKKAYRLGSQKPVQRAAICQNLQHVLAVVRLQQQLEEAEGRDPQGAMVICEQLGDLFSKAGDFPRAAEAYQKQLRFAELLDRPGAERAIIHVSLATTLGDMKDHHGAVRHYEEELRLRSGNVLEEAKTWLNIALSREEAGDAYELLAPCFQKALSCAQQAQRPQLQRQVLQHLHTVQLRLQPQEAPETETRLRELSVAEDEDEEEEAEEAAATAESEALEAGEVELSESEDDTDGLTPQLEEDEELQGHLGRRKGSKWNRRNDMGETLLHRASVCRSHPLPLLVPPSDSRSDHGSMHRGTKKRHKTEGKPHDEIPREPATNKNKKRKTSKDEETKEEVRSKSNQDRDEEQTGSKSEKGKPHR

SEQ ID NO: 805660 - protein, 1376 aa, Homo sapiens
HEGELRQLSKAKAKAQRAGQRREEAALCHQLGELLAGHGRYAEALEQHWQELQLRERADDPLGCAVAHRKIGERLAEMEDYPAALQHQHQYLELAHSLRNHTELQRAWATIGRTHLDIYDHCQSRDALLQAQAAFEKSLAIVDEELEGTLAQGELNEMRTRLYLNLGLTFESLQQTALCNDYFRKSIFLAEQNHLYEDLFRARYNLGTIHWRAGQHSQAMRCLEGARECAHTMRKRFMESECCVVIAQVLQDLGDFLAAKRALKKAYRLGSQKPVQRAAICQNLQHVLAVVRLQQQLEEAEGRDPQGAMVICEQLGDLFSKAGDFPRAAEAYQKQLRFAELLDRPGAERAIIHVSLATTLGDMKDHHGAVRHYEEELRLRSGNVLEEAKTWLNIALSREEAGDAYELLAPCFQKALSCAQQAQRPQLQRQVLQHLHTVQLRLQPQEAPETETRLRELSVAEDEDEEEEAEEAAATAESEALEAGEVELSESEDDTDGLTPQLEEDEELQGHLGRRKGSKWNRRNDMGETLLHRACIEGQLRRVQDLVRQGHPLNPRDYCGWTPLHEACNYGHLEIVRFLLDHGAAVDDPGGQGCEGITPLHDALNCGHFEVAELLLERGASVTLRTRKGLSPLETLQQWVKLYRRDLDLETRQKARAMEMLLQAAASGQDPHSSQAFHTPSSLLFDPETSPPLSPCPEPPSNSTRLPEASQAHVRVSPGQAAPAMARPRRSRHGPASSSSSSEGEDSAGPARPSQKRPRCSATAQRVAAWTPGPASNREAATASTSRAAYQAAIRGVGSAQSRLGPGPPRGHSKALAPQAALIPEEECLAGDWLELDMPLTRSRRPRPRGTGDNRRPSSTSGSDSEESRPRARAKQVRLTCMQSCSAPVNAGPSSLASEPPGSPSTPRVSEPSGDSSAAGQPLGPAPPPPIRVRVQVQDHLFLIPVPHSSDTHSVAWLAEQAAQRYYQTCGLLPRLTLRKEGALLAPQDLIPDVLQSNDEVLAEVTSWDLPPLTDRYRRACQSLGQGEHQQVLQAVELQGLGLSFSACSLALDQAQLTPLLRALKLHTALRELRLAGNRLGDKCVAELVAALGTMPSLALLDLSSNHLGPEGLRQLAMGLPGQATLQSLEELDLSMNPLGDGCGQSLASLLHACPLLSTLRLQACGFGPSFFLSHQTALGSAFQDAEHLKTLSLSYNALGAPALARTLQSLPAGTLLHLELSSVAAGKGDSDLMEPVFRYLAKEGCALAHLTLSANHLGDKAVRDLCRCLSLCPSLISLDLSANPEISCASLEELLSTLQKRPQGLSFLGLSGCAVQGPLGLGLWDKIAAQLRELQLCSRRLCAEDRDALRQLQPSRPGPGECTLDHGSKLFFRRL

SEQ ID NO: 805661 - protein, 633 aa, Homo sapiens
MPDSNSSLLAIGLHDLGARTEHGFSFEKSLAIVDEELEGTLAQGELNEMRTRLYLNLGLTFESLQQTALCNDYFRKSIFLAEQNHLYEDLFRARYNLGTIHWRAGQHSQAMRCLEGARECAHTMRKRFMESECCVVIAQVLQDLGDFLAAKRALKKAYRLGSQKPVQRAAICQNLQHVLAVVRLQQQLEEAEGRDPQGAMVICEQLGDLFSKAGDFPRAAEAYQKQLRFAELLDRPGAERAIIHVSLATTLGDMKDHHGAVRHYEEELRLRSGNVLEEAKTWLNIALSREEAGDAYELLAPCFQKALSCAQQAQRPQLQRQVLQHLHTVQLRLQPQEAPETETRLRELSVAEDEDEEEEAEEAAATAESEALEAGEVELSESEDDTDGLTPQLEEDEELQGHLGRRKGSKWNRRNDMGETLLHRACIEGQLRRVQDLVRQGHPLNPRDYCGWTPLHEACNYGHLEIVRFLLDHGAAVDDPGGQGCEGITPLHDALNCGHFEVAELLLERGASVTLRTRKGLSPLETLQQWVKLYRRDLDLETRQKARAMEMLLQAAASGQDPHSSQAFHTPSSLLFDPETSPPLSPCPEPPSNSTRLPEASQAHVRVSPGQAAPAMARPRRSRHGPASSSPLS

SEQ ID NO: 805662 - protein, 115 aa, Homo sapiens
MPSTVATSRWLSCCLNGGRPSPSALERLHERRRPFPALPRLGRPRASARAAFPHFCSSPIPGSTVHSQLAGSALLSRASPPRASCACPPGPLLLPSPSEFILLPGPLGQKQGCRS

SEQ ID NO: 805663 - protein, 102 aa, Homo sapiens
MASTLGELDPDVPYLHERRRPFPALPRLGRPRASARAAFPHFCSSPIPGSTVHSQLAGSALLSRASPPRASCACPPGPLLLPSPSEFILLPGPLGQKQGCRS

SEQ ID NO: 805664 - protein, 440 aa, Homo sapiens
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 805665 - protein, 521 aa, Homo sapiens
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGRYFVGLEGCRARWVGPDHWAWTSEFYGGDGGGLALGPGILRLTGISEVPFSAPLLLVVGGDSKGREGRGTSPWIEVFLAFGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 805666 - protein, 215 aa, Homo sapiens
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCRESGMWHWLWVSTPDPNSAPQLPQEATWHPTTFCSTTWCPTT

SEQ ID NO: 805667 - protein, 160 aa, Homo sapiens
MGLGVSAEQPAGGAEGFHLHGVQENSPAQQAGLEPYFDFIITIGHSRLVEFPNLPLLCLLMCVCVSSSVPQGAPVYPSLPFFLKGVPALSPLLPGLYSEPDWGPAQCSASELCGVDRGHMASWRWQQGPRPASWGMRDMRALAKGQLRVGQHWNAVDLGG

SEQ ID NO: 805668 - protein, 143 aa, Homo sapiens
DSRGLPLSPTPEDSPSLETGSRQSDYMEDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGVWRAGGGWRA

SEQ ID NO: 805669 - protein, 322 aa, Homo sapiens
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNTDSS

SEQ ID NO: 805670 - protein, 535 aa, Homo sapiens
GRGLGTSSAAPRVRSYCSRSRMRYSLVPARAGNWSPPSSGRKNVTYYPCRGLHIRATYAQHLTPRSACGPALLCLGSGEVEVKPSPEDTSRGAWGLTRGVTQHARGAPFGARTCQFVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 805671 - protein, 367 aa, Homo sapiens [sequence omitted]

SEQ ID NO: 805672 - protein, 302 aa, Homo sapiens
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREPPATTRSHLAPHHLLLYHLVPHHLMLYHLDPPPRTLLPWRQVPGRVTTWRPCCRHLAPPWRIPFLGLGVPATVLQTLMDFPISWRLLFSPHLQCSELWTQASWTCREFLSWTTAMPVCGPACPLPQN

SEQ ID NO: 805673 - protein, 440 aa, Homo sapiens; identical to SEQ ID NO: 805664

SEQ ID NO: 805674 - protein, 440 aa, Homo sapiens; identical to SEQ ID NO: 805664

SEQ ID NO: 805675 - protein, 440 aa, Homo sapiens; identical to SEQ ID NO: 805664

SEQ ID NO: 805676 - protein, 440 aa, Homo sapiens; identical to SEQ ID NO: 805664

SEQ ID NO: 805677 - protein, 440 aa, Homo sapiens; identical to SEQ ID NO: 805664

SEQ ID NO: 805678 - protein, 440 aa, Homo sapiens; identical to SEQ ID NO: 805664

SEQ ID NO: 805679 - protein, 440 aa, Homo sapiens; identical to SEQ ID NO: 805664

SEQ ID NO: 805680 - protein, 431 aa, Homo sapiens
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGSPVSSLLECRK

SEQ ID NO: 805681 - protein, 252 aa, Homo sapiens
MAENTEGDLNSNLLHAPYHTGDPQLDTAIGQWLRWDKNPKTKEQIENLLRNGMNKELRDRLCCRMTFGTAGLRSAMGAGFCYINDLTVIQSTQGMYKYLERCFSDFKQRGFVVGYDTRGQVTSSCSSQRLAKLTAAVLLAKDVPVYLFSRYVPTPFVPYAVQKLKAVAGVMITASHNRKEDNGYKVYWETGAQITSPHDKEILKCIEECVEPWNGSWNDNLVDTSPLKRDPLQDICRRYMEDLKKICFYRGS

SEQ ID NO: 805682 - protein, 132 aa, Homo sapiens
MAENTEGDLNSNLLHAPYHTGDPQLDTAIGQWLRWDKVGTWSARQTPSPPPHSLLFPVPTQRPAGCRGDGSGHRAGGSGAGRCHPPMRGVAPSDCQSRAATSASLPSAVLSIVTSLPLLYPLSFQVLSSLFL

SEQ ID NO: 805683 - protein, 150 aa, Homo sapiens
ALRCALPERGSRTPSTRSAVLVDRVAGLGTELTLTPSSRRAHGSHPLSSERQAAPTRAFCSADPLPRPPSFVPSLPSPQAQGQAVRQPRLLRAALARGAPRGRTPSPRPGPAPALQPYALTRFPASLSLPDLVFTSVGSSLVICLVPTPL

SEQ ID NO: 805684 - protein, 150 aa, Homo sapiens; identical to SEQ ID NO: 805683

SEQ ID NO: 805685 - protein, 411 aa, Homo sapiens
MRIAMPTTSHPTCFNASVCSPGGESLQSSGEGMKLRQFTQVPLTNAFVNPVIGLLHVCAHKLEGIGSGQEWKEFILLGLKIQNLWFWFTWLHFRLVPHSAVSDGNGARLRQSPSSFSHKEGPDKHHGPVSQLVTQRFHVCAIRLHLGILHQHVFSGNTMVVHFEVAIVYLIITKFGADVTNGNSWQRLMGPDFTNRYDKGMKSIAFPLSDELGKNYCMIGSLSKPTRPPFNGGHSRTVENELLGFRVIRGCGFQASKVSSMTHLCLGISANDLQVPGGHEEALLLLRSCLVKQGGQEHAQVKIQRLRPPSVHKIFKPHNFIRVSDAKLPHLLHHDGTFPDSHLITLAASEEVQVLMLEVWVVQDHVLDLSAAPGFLGAAVQDVCKQLRVEAGGIPLPAQVRVHGDDQLAAK

SEQ ID NO: 805686 - protein, 333 aa, Homo sapiens
MEAGGATGSAGLGCKLPSAFCFPGSSVAMDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVPNLEPEGRDLLMQLLQYDPSQRITAKTALAHPYFSSPEPSPAARQYVLQRFRH

SEQ ID NO: 805687 - protein, 141 aa, Homo sapiens
PVYQESSKSLSTIWLQEPMMLPKPGTYYLPWEVSAGQVPDGSTLRTFGRLCLYDMIQSRVTLMAQHGSDQHQVLVCTKLVEPFHAQVGSLYIVLGELQHQQDRGSVVKARVLTCVEGMNLPLLEQAIREQRLYKQERGGSQ

SEQ ID NO: 805688 - protein, 122 aa, Homo sapiens
MLPKPGTYYLPWEVSAGQVPDGSTLRTFGRLCLYDMIQSRVTLMAQHGSDQHQVLVCTKLVEPFHAQVGSLYIVLGELQHQQDRGSVVKARVLTCVEGMNLPLLEQAIREQRLYKQERGGSQ

SEQ ID NO: 805689 - protein, 411 aa, Homo sapiens; identical to SEQ ID NO: 805685

SEQ ID NO: 805690 - protein, 455 aa, Homo sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 805691 - protein, 455 aa, Homo sapiens; identical to SEQ ID NO: 805690

SEQ ID NO: 805692 - protein, 373 aa, Homo sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKVRSPAEARGGGWEGLKCITTFPHSQLIHLPLTTEPQEG

SEQ ID NO: 805693 - protein, 485 aa, Homo sapiens
MRLLAWLIFLANWGGARAEPEEAQGPCAQEKGKGPPPTSILASLAPGLEAGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 805694 - protein, 473 aa, Homo sapiens
MDNKQANKEEAQGPCAQEKGKGPPPTSILASLAPGLEAGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 805695 - protein, 98 aa, Homo sapiens
CLNHLGAFRMLYDDAGVPISAMFITPGVTPWKTTLPGVVNGANNPAIRVFEYDRATLSLKVRSPAEARGGGWEGLKCITTFPHSQLIHLPLTTEPQEG

SEQ ID NO: 805696 - protein, 741 aa, Homo sapiens
MLARLVSNSDLKCSACLSLPKCWDYRCEPLRPATSCSFFFFFPQDRVSLCCPGWSEVVCSRLTATPPPEFKRFSCLSLPNELRLQAHATQSANFYIFSRDGISPRWPGWSQTPDLRCPPSLASHNVRITGVSHRAQPHLSLLIMLNVFLNAVIIHQHQLIMVHRCLSLHELLSSDTKCGSGWFLGCLIKEEFKKGIVSRGVSKAKRINKERSGTSTSEKLLLSPHPPPHSRTERARSPARTVTMPERPSSRVYSPERVVASRTGARLVMGDTYPDLSLYPSSDLLPVPFHHWPRPSGIPGDAACRSQASQNRGGQSGSENRNDHFHAYTVPGPQKQILFCFNLNNLVIENHKKAKPLFSLILKIVFSFCEERVIREGICSLWDLLNAVVLSAEELRTSDVHSPLPLFLTGSNGHEFVFLLKGHEDLRQDERVMQLFGLVNTLLANDPTSLRKNLRYSETLKWQQFEKSSGFFLHLSRVVMYYILTKNYKIREPGMVTHACESQKLQRLRQGDGLSPGVQGCSELVIVPLPSSLGNESKTVSLEEKGWAWWLAPIILIFCNAKVGGSLEAQEFKTSLNNIERPHHYLFKKIKKVTGHGGPCLESQHFGRPRQVDHLRSGVRDQPGQHGETLCLLKIQKLAGRGGGHLYSRLLRRLRHENCLNLGGGGCSEPRLHHCTPGWATRVKLHLKNEITKVRKKKLSGQAWWLTCNPDTLEGYSRRIAGDQEFKTILDKKVRPCLYKK

SEQ ID NO: 805697 - protein, 151 aa, Homo sapiens
MSSFSTTTVSFLLLLAFQLLGQTRANPMYNAVSNADLMDFKNLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 805698 - protein, 112 aa, Homo sapiens
MANLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 805699 - protein, 234 aa, Homo sapiens
MTPVRMQHSLAGQTYAVPLIQPDLRREEAVQQMADALQYLQKVSGDIFSRGRAEPEPGAGHWREGLLGPGQDEKIKGSKKAIKVFSSAKYPAPERLQEYGSIFTGAQDPGLQRRPRHRIQSKHRPLDERALQEKLTFLLCVSTKPEPEDDAEEGLGGLPSNISSVSSLLLFNTTENLEKKYVFLGPPGWCCNKDPVMLGGRDRGEAGLMPPCPSGRERRLEQQVPENYFYVAGP

SEQ ID NO: 805700 - protein, 96 aa, Homo sapiens
KGGMRDVKAQATEDLVGAGQTFSVPFKSLHVVTFPQLRVNHEWPALTVDENGGILHGHAVGWEALVLPGSHVSIIHQHPQGIQGWGDWNGSLVKKK

SEQ ID NO: 805701 - protein, 426 aa, Homo sapiens
MEGHKAEEEVLDVLRLNVGGCIYTARRESLCRFKDSMLASMFSGRFPLKTDESGACVIDRDGRLFKYLLDYLHGEVQIPTDEQTRIALQEEADYFGIPYPYSLSDHLANEMETYSLRSNIELKKALTDFCDSYGLVCNKPTVWVLHYLNTSGASCESRIIGVYATKTDGTDAIEKQLGGRIHSKGIFKREAGNNVQYIWSYYSVAELKKMMDAFDAWEGKGVSYWRVPHELIECWTLEERPLLGSLRHMAPIRKRRLITFNEADESVNYKTGPKPVRFLGPSTSTQIKVKNSASVTVSPASAIQTSAGATANRFQSGSRRKAAQRSAPSRATALVGTGAPGHPQASPGAASAENGGTHLPPAKVLLSDKKPTPQRVIKLKRTPLCATAPCLPSPTATRQANSLKPLPGEAARALGVRTENGKNKGN

SEQ ID NO: 805702 - protein, 426 aa, Homo sapiens; identical to SEQ ID NO: 805701

SEQ ID NO: 805703 - protein, 217 aa, Homo sapiens
MMDAFDAWEGKGVSYWRVPHELIECWTLEERPLLGSLRHMAPIRKRRLITFNEADESVNYKTGPKPVRFLGPSTSTQIKVKNSASVTVSPASAIQTSAGATANRFQSGSRRKAAQRSAPSRATALVGTGAPGHPQASPGAASAENGGTHLPPAKVLLSDKKPTPQRVIKLKRTPLCATAPCLPSPTATRQANSLKPLPGEAARALGVRTENGKNKGN

SEQ ID NO: 805704 - protein, 419 aa, Homo sapiens
MEGHKAEEEVLDVLRLNVGGCIYTARRESLCRFKDSMLASMFSGRFPLKTDESGACVIDRDGRLFKYLLDYLHGEVQIPTDEQTRIALQEEADYFGIPYPYSLSDHLANEMETYSFKALTDFCDSYGLVCNKPTVWVLHYLNTSGASCESRIIGVYATKTDGTDAIEKQLGGRIHSKGIFKREAGNNVQYIWSYYSVAELKKMMDAFDAWEGKGVSYWRVPHELIECWTLEERPLLGSLRHMAPIRKRRLITFNEADESVNYKTGPKPVRFLGPSTSTQIKVKNSASVTVSPASAIQTSAGATANRFQSGSRRKAAQRSAPSRATALVGTGAPGHPQASPGAASAENGGTHLPPAKVLLSDKKPTPQRVIKLKRTPLCATAPCLPSPTATRQANSLKPLPGEAARALGVRTENGKNKGN

SEQ ID NO: 805705 - protein, 204 aa, Homo sapiens
MGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 805706 - protein, 148 aa, Homo sapiens
MLKMGHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 805707 - protein, 116 aa, Homo sapiens
MAPLRFSANLSWLFPELPGLPARVRAAGSSGFEAVEVAWPYAETPEALARAAREAGLRLVLINTPPGDQEKGEMGLGAVPGRQAAFREGLEQAVRYAKALGCPRYPAPPHPHPCDP

SEQ ID NO: 805708 - protein, 116 aa, Homo sapiens; identical to SEQ ID NO: 805707

SEQ ID NO: 805709 - protein, 116 aa, Homo sapiens; identical to SEQ ID NO: 805707

SEQ ID NO: 805710 - protein, 116 aa, Homo sapiens; identical to SEQ ID NO: 805707

SEQ ID NO: 805711 - protein, 116 aa, Homo sapiens; identical to SEQ ID NO: 805707

SEQ ID NO: 805712 - protein, 116 aa, Homo sapiens; identical to SEQ ID NO: 805707

SEQ ID NO: 805713 - protein, 180 aa, Homo sapiens
MDWRPGETDEGWHSQGILEEVQREPREARPPVHLPHRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVG

SEQ ID NO: 805714 - protein, 112 aa, Homo sapiens [sequence omitted]

SEQ ID NO: 805715 - protein, 112 aa, Homo sapiens [sequence omitted]

SEQ ID NO: 805716 - protein, 112 aa, Homo sapiens [sequence omitted]

SEQ ID NO: 805717 - protein, 237 aa, Homo sapiens
MAPLRFSANLSWLFPELPGLPARVRAAGSSGFEAVEVAWPYAETPEALARAAREAGLRLVLINTPPGDQEKGEMGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKDIFHWQIMDGNLTGNIREFLPIVGHVQVAQVPGRGEPSSPGELNFPYLFQLLEDEGYKGFVG

SEQ ID NO: 805718 - protein, 110 aa, Homo sapiens
MPRTPPGPASPGMAPLRFSANLSWLFPELPGLPARVRAAGSSGFEAVEVAWPYAETPEALARAAREAGLRLVLINTPPGDQEKGEMGLGAVPGRQAAFREGLEQAVFILG

SEQ ID NO: 805719 - protein, 82 aa, Homo sapiens
SEDPPSSPIIATGPSGSQLSLASRPALRPWSSASNLRHAAGVLAQVRKVETHTYLHVSVGVRRRGCTVGTAREAASLGQRNR

SEQ ID NO: 805720 - protein, 174 aa, Homo sapiens
MGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVG

SEQ ID NO: 805721 - protein, 45 aa, Homo sapiens
MGSCTDTFWKVPPYLNLNVEDWRLREVGHALYVDHLLHLRAPSPL

SEQ ID NO: 805722 - protein, 277 aa, Homo sapiens [sequence omitted]

SEQ ID NO: 805723 - protein, 116 aa, Homo sapiens; identical to SEQ ID NO: 805707

SEQ ID NO: 805724 - protein, 116 aa, Homo sapiens; identical to SEQ ID NO: 805707

SEQ ID NO: 805725 - protein, 116 aa, Homo sapiens; identical to SEQ ID NO: 805707

SEQ ID NO: 805726 - protein, 180 aa, Homo sapiens; identical to SEQ ID NO: 805713

SEQ ID NO: 805727 - protein, 247 aa, Homo sapiens
MAPLRFSANLSWLFPELPGLPARVRAAGSSGFEAVEVAWPYAETPEALARAAREAGLRLVLINTPPGDQEKGEMGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVG

SEQ ID NO: 805728 - protein, 112 aa, Homo sapiens [sequence omitted]

SEQ ID NO: 805729 - protein, 164 aa, Homo sapiens
MAPLRFSANLSWLFPELPGLPARVRAAGSSGFEAVEVAWPYAETPEALARAAREAGLRLVLINTPPGDQEKGEMGLGAVPGRQAAFREGLEQAVGSHLTEGRKTQPPITNGHIPLADHGWEPDRKHPGVPAHCWACAGGTGPRPRGAQQPRRAEFPLSVSTAGR

SEQ ID NO: 805730 - protein, 280 aa, Homo sapiens
ARTHPAGSQACALRFSANLSWLFPELPGLPARVRAAGSSGFEAVEVAWPYAETPEALARAAREAGLRLVLINTPPGDQEKGEMGLGAVPGRQAAFREGLEQAVSGHCLMGRKLSVPCKGAVARGGLVYLAAFLRLDMIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVG

SEQ ID NO: 805731 - protein, 190 aa, Homo sapiens
MSCTVYAKTQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 805732 - protein, 308 aa, Homo sapiens
MGNTLGLAPMGTLPRRSPRREEPLPNPGSFDELHRLCKDVFPAQMEGVKLVVNKVLSSHFQVAHTIHMSALGLPGYHLHAAYAGDWQLSPTEVFPTVVGDMDSSGSLNAQVLLLLAERLRAKAVFQTQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 805733 - protein, 274 aa, Homo sapiens
MGNTLGLAPMGTLPRRSPRREEPLPNPGSFDELHRLCKDVFPAQMEGVKLVVNKVLSSHFQVAHTIHMSALGLPGYHLHAAYAGDWQLSPTETQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 805734 - protein, 308 aa, Homo sapiens; identical to SEQ ID NO: 805732

SEQ ID NO: 805735 - protein, 308 aa, Homo sapiens; identical to SEQ ID NO: 805732

SEQ ID NO: 805736 - protein, 308 aa, Homo sapiens; identical to SEQ ID NO: 805732

SEQ ID NO: 805737 - protein, 230 aa, Homo sapiens
MGNTLGLAPMGTLPRRSPRREEPLPNPGSFDELHRLCKDVFPAQMEGVKLVVNKVLSSHFQVAHTIHMSALGLPGYHLHAAYAGDWQLSPTEVFPTVVGDMDSSGSLNAQVLLLLAERLRAKAVFQTQQAKFLTWQFDGEYRGDDYTATLTLGNPDLIGESVIMVAHFLQSLTHRLVLGGELVYHRRPGEEGAILTLAGKYSGMGRSEVVVVVGGNTKTCPIGHGLRTCT

SEQ ID NO: 805738 - protein, 308 aa, Homo sapiens; identical to SEQ ID NO: 805732

SEQ ID NO: 805739 - protein, 274 aa, Homo sapiens [sequence omitted]

SEQ ID NO: 805740 - protein, 243 aa, Homo sapiens
MGNTLGLAPMGTLPRRSPRREEPLPNPGSFDELHRLCKDVFPAQMEGVKLVVNKVLSSHFQTQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 805741 - protein, 308 aa, Homo sapiens; identical to SEQ ID NO: 805732

SEQ ID NO: 805742 - protein, 352 aa, Homo sapiens
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQMAPVAITLVSDGTRCLLARQSSFPKGMYSALAGFCDIGESVEETIRREVAEEVGLEVESLQYYASQHWPFPSGSLMIACHATVKPGQTEIQVNLRELETAAWFSHDEVATALKRKGPYTQQQNGTFPFWLPPKLAISHQLIKEWVEKQTCSSLPA

SEQ ID NO: 805743 - protein, 226 aa, Homo sapiens
METELKGSFIELRKALFQLNARDASLLSTAQALLRWHDAHQFCSRSGQPTKKNVAGSKRVCPSNNIIYYPQMAPVAITLVSDGTRCLLARQSSFPKGMYSALAGFCDIGESVEETIRREVAEEVGLEVESLQYYASQHWPFPSGSLMIACHATVKPGQTEIQVNLRELETAAWFSHDEVATALKRKGPYTQQQNGTFPFWLPPKLAISHQLIKEWVEKQTCSSLPA

SEQ ID NO: 805744 - protein, 235 aa, Homo sapiens
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQVKVWKRPSAEKLQKRWDWRWKACSTMHPSIGPSLVAHS

SEQ ID NO: 805745 - protein, 328 aa, Homo sapiens
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQMAPVAITLVSDGTRCLLARQSSFPKGMYSALAGFCDIGESVEETIRREVAEEVGLEVESLQYYASQHWPFPSGSLMIACHATVKPGQTEVSSHLPLYCDISFASSNLLISKYLLSTCLVQHHLDYINMCKI

SEQ ID NO: 805746 - protein, 287 aa, Homo sapiens
VRLRPTRTARRTRKVPRKEFRDLTMSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQIQVNLRELETAAWFSHDEVATALKRKGPYTQQQNGTFPFWLPPKLAISHQLIKEWVEKQTCSSLPA

SEQ ID NO: 805747 - protein, 405 aa, Homo sapiens
GKESSLGGSLGPGVAHCVPSPSLPHQPVPPWGSLPRGGGPPPVPLPGGLHRTLLRRGNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805748 - protein, 300 aa, Homo sapiens
MPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805749 - protein, 730 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGGEEVGGGRRSREGAGRARFRPAGRGLSVLSPCSSTALPAKREQPPSLTRNGPLSCGQRLRKSLSSMTRVVGGLVALRGAHPYIAALYWGHSFCAGSLIAPCWVLTAAHCLQDRRVPARPEPPQGRGSSVSQRSFHAAPEPVPYLLPPHPSFHAPPELPGRKLEHGIGVREQGASPERLWPGLRALPLPYPPRRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805750 - protein, 547 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGGEEVGGGRRSREGAGRARFRPAGRGLSVLSPCSSTALPAKREQPPSLTRNGPLSCGQRLRKSLSSMTRVVGGLVALRGAHPYIAALYWGHSFCAGSLIAPCWVLTAAHCLQDRRVPARPEPPQGPRLLRLPAQLPRCTRTRALPSPAPPFFPRPSGAPGEEAGTRDWGSGAGGFPRTLVARSESAASPLPSPQARTRGSDGGARPGTP

SEQ ID NO: 805751 - protein, 380 aa, Homo sapiens
MPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRRVPARPEPPQGPRLLRLPAQLPRCTRTRALPSPAPPFFPRPSGAPGEEAGTRDWGSGAGGFPRTLVARSESAASPLPPRRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805752 - protein, 547 aa, Homo sapiens; identical to SEQ ID NO: 805750

SEQ ID NO: 805753 - protein, 750 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRRVPARPEPPQGPRLLRLPAQLPRCTRTRALPSPAPPFFPRPSGAPGEEAGTRDWGSGAGGFPRTLVARSESAASPLPPRRPAPEDLTVVLGQERRNHSCEPCQTLAVRSYRLHEAFSPVSYQHDLALLRLQEDADGSCALLSPYVQPVCLPSGAARPSETTLCQVAGWGHQFEASLPMKLINGTSSPSGLLRERKGMSGFTSAWSSFVHRPGGKRCQMGCEEGSSVFAGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805754 - protein, 615 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805755 - protein, 137 aa, Homo sapiens
MSGFTSAWSSFVHRPGGKRCQMGCEEGSSVFAGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805756 - protein, 615 aa, Homo sapiens; identical to SEQ ID NO: 805754

SEQ ID NO: 805757 - protein, 615 aa, Homo sapiens; identical to SEQ ID NO: 805754

SEQ ID NO: 805758 - protein, 695 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRRVPARPEPPQGPRLLRLPAQLPRCTRTRALPSPAPPFFPRPSGAPGEEAGTRDWGSGAGGFPRTLVARSESAASPLPPRRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805759 - protein, 758 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGGEEVGGGRRSREGAGRARFRPAGRGLSVLSPCSSTALPAKREQPPSLTRNGPLSCGQRLRKSLSSMTRVVGGLVALRGAHPYIAALYWGHSFCAGSLIAPCWVLTAAHCLQDRRVPARPEPPQGRGSSVSQRSFHAAPEPVPYLLPPHPSFHAPPELPGRKLEHGIGVREQGASPERLWPGLRALPLPYPPRRPAPEDLTVVLGQERRNHSCEPCQTLAVRSYRLHEAFSPVSYQHDLGAVGAPRGDGKRAWGPGVPASRSSPPGLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805760 - protein, 547 aa, Homo sapiens; identical to SEQ ID NO: 805750

SEQ ID NO: 805761 - protein, 326 aa, Homo sapiens
MTRVVGGLVALRGAHPYIAALYWGHSFCAGSLIAPCWVLTAAHCLQDRRVPARPEPPQGPRLLRLPAQLPRCTRTRALPSPAPPFFPRPSGAPGEEAGTRDWGSGAGGFPRTLVARSESAASPLPPRRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 805762 - protein, 547 aa, Homo sapiens; identical to SEQ ID NO: 805750

SEQ ID NO: 805763 - protein, 137 aa, Homo sapiens; identical to SEQ ID NO: 805755

SEQ ID NO: 805764 - protein, 125 aa, Homo sapiens [sequence omitted]

SEQ ID NO: 805765 - protein, 365 aa, Homo sapiens
MTWAEVASPQRGCGAGPAPREFPKARKPSRAPLAMETVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805766 - protein, 340 aa, Homo sapiens
MMRARAPLAMETVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805767 - protein, 365 aa, Homo sapiens; identical to SEQ ID NO: 805765

SEQ ID NO: 805768 - protein, 299 aa, Homo sapiens
MKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805769 - protein, 299 aa, Homo sapiens; identical to SEQ ID NO: 805768

SEQ ID NO: 805770 - protein, 336 aa, Homo sapiens
RDRVAMETVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805771 - protein, 381 aa, Homo sapiens
MTWAEVASPQRGCGAGPAPREFPKARKPSRAPLAMETVISSDSSPAVENEHPQETPESNNSVYTSFMKSHRCYDLIPTSSKLVVFDTSLQSCPCGFAFMIITVLAQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805772 - protein, 328 aa, Homo sapiens
MTWAEVASPQRDVGRGLPQESFLKRGNQAGRLLQWRRSFLQIAPQLWKMSILKVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805773 - protein, 247 aa, Homo sapiens
MLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805774 - protein, 365 aa, Homo sapiens; identical to SEQ ID NO: 805765

SEQ ID NO: 805775 - protein, 299 aa, Homo sapiens; identical to SEQ ID NO: 805768

SEQ ID NO: 805776 - protein, 247 aa, Homo sapiens; identical to SEQ ID NO: 805773

SEQ ID NO: 805777 - protein, 333 aa, Homo sapiens
MRIRGRVDTAATTEGGAPLAMETVISSDSSPAVVMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805778 - protein, 270 aa, Homo sapiens
LVIQRIPAARLFYGIVRSKRFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805779 - protein, 106 aa, Homo sapiens
PPLSVVDEKGQMVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805780 - protein, 365 aa, Homo sapiens; identical to SEQ ID NO: 805765

SEQ ID NO: 805781 - protein, 365 aa, Homo sapiens; identical to SEQ ID NO: 805765

SEQ ID NO: 805782 - protein, 331 aa, Homo sapiens
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 805783 - protein, 249 aa, Homo sapiens
ELCLGRGLACIRKEGAGCGKMAAQPLRHRSRCATPPRGDFCGGTERAIDQASFTTSMEWDTQVVKGSSPLGPAGLGAEEPAAGPQLPSWLQPERCAVFQCAQCHAVLADSVHLAWDLSRSLGAVVFSRVTNNVVLEAPFLVGIEGSLKGSTYNLLFCGSCGIPVGFHLYSTHAALAALRGHFCLSSDKMVCYLLKTKAIVNASEMDIQNVPLSEKIAELKEKIVLTHNRLKSLMKILSEVTPDQSKPEN

SEQ ID NO: 805784 - protein, 69 aa, Homo sapiens
SCAWGGAWRVFERKAPAAGRWRLSRCGIAHVVQRRPGGTFVVALRGRLTKLLLRPVAVPRGRGLLQSYK

SEQ ID NO: 805785 - protein, 249 aa, Homo sapiens; identical to SEQ ID NO: 805783

SEQ ID NO: 805786 - protein, 208 aa, Homo sapiens
ELCLGRGLACIRKEGAGCGKMAAQPLRHRSRCATPPRGDFCGGTERAIDQASFTTSMEWDTQVVKGSSPLGPAGLGAEEPAAGPQLPSWLQPERCAVFQCAQCHAVLADSVHLAWDLSRSLGAVVFSRVTNNVVLEAPFLVGIEGSLKGSYLLKTKAIVNASEMDIQNVPLSEKIAELKEKIVLTHNRLKSLMKILSEVTPDQSKPEN

SEQ ID NO: 805787 - protein, 199 aa, Homo sapiens
MEDAAAPGRTEGVLERQGAPPAAGQGGALVELTPTPGGLALVSPYHTHRAGDPLDLVALAEQVQKADEFIRANATNKLTVIAEQIQHLQEQARKVLEDAHRDANLHHVACNIVKKPGNIYYLYKRESGQQYFSIISPKEWGTSCPHDFLGAYKLQHDLSWTPYEDIEKQDAKISMMDTLLSQSVALPPCTEPNFQGLTH

SEQ ID NO: 805788 - protein, 146 aa, Homo sapiens
SYSHSPGSGEDKALSWRTPPRRGGPRGSLKGKERRQLQAREVLEDAHRDANLHHVACNIVKKPGNIYYLYKRESGQQYFSIISPKEWGTSCPHDFLGAYKLQHDLSWTPYEDIEKQDAKISMMDTLLSQSVALPPCTEPNFQGLTH

SEQ ID NO: 805789 - protein, 199 aa, Homo sapiens; identical to SEQ ID NO: 805787

SEQ ID NO: 805790 - protein, 175 aa, Homo sapiens
SYSHSPGSGEDKALSWRTPPRRGGPRGSLKGKERRQLQAREADEFIRANATNKLTVIAEQIQHLQEQARKVLEDAHRDANLHHVACNIVKKPGNIYYLYKRESGQQYFSIISPKEWGTSCPHDFLGAYKLQHDLSWTPYEDIEKQDAKISMMDTLLSQSVALPPCTEPNFQGLTH

SEQ ID NO: 805791 - protein, 972 aa, Homo sapiens
MEYIFPNTGVLWSWLINILCNRRIVWFTSSQLPRGPPASSGGHSFHTLRERSESRLFVESYAAAWQPPGTSGGASCCSSLSAQVMSSEFLAELHWEDGFAIPVANEENKLLEDQLSKLKDERASLQDELREYEERINSMTSHFKNVKQELSITQSLCKARERETESEEHFKAIAQRELGRVKDEIQRLENEMASILEKKSDKENGIFKATQKLDGLKCQMNWDQQALEAWLEESAHKDSDALTLQKYAQQDDNKIRALTLQLERLTLECNQKRKILDNELTETISAQLELDKAAQDFRKIHNERQELIKQWENTIEQMQKRDGDIDNCALELARIKQETREKENLVKEKIKFLESEIGNNTEFEKRISVADRKLLKCRTAYQDHETSRIQLKGELDSLKATVNRTSSDLEALRKNISKIKKDIHEETARLQKTKNHNEIIQTKLKEITEKTMSVEEKATNLEDMLKEEEKDVKEVDVQLNLIKGVLFKKAQELQTETMKEKAVLSEIEGTRSSLKHLNHQLQKLDFETLKQQEIMYSQDFHIQQVERRMSRLKGEINSEEKQALEAKIVELRKSLEEKKSTCGLLETQIKKLHNDLYFIKKAHSKNSDEKQSLMTKINELNLFIDRSEKELDKAKGFKQDLMIEDNLLKLEVKRTREMLHSKAEEVLSLEKRKQQLYTAMEERTEEIKVHKTMLASQIRYVDQERENISTEFRERLSKIEKLKNRYEILTVVMLPPEGEEEKTQAYYVIKVMKYELKIQLEEQKRAVDEKYRYKQRQIRELQEDIQSMENTLDVIEHLANNVKEKLSEKQAYSFQLSKETEEQKPKLERVTKQCAKLTKEIRLLKDTKDETMEEQDIKLREMKQFHKVIDEMLVDIIEENTEIRIILQTYFQQSGLELPTASTKGSRQSSRSPSHTSLSARSSRSTSTSTSQSSIKVLELKFPASSSLVGSPSRPSSASSSSSNVKSKKSSK

SEQ ID NO: 805792 - protein, 981 aa, Homo sapiens
RAPPAIAAALCRCLGLTRVLLTRCTRRRIFALYLLYPFAVMSSEFLAELHWEDGFAIPVANEENKLLEDQLSKLKDERASLQDELREYEERINSMTSHFKNVKQELSITQSLCKARERETESEEHFKAIAQRELGRVKDEIQRLENEMASILEKKSDKENGIFKATQKLDGLKCQMNWDQQALEAWLEESAHKDSDALTLQKYAQQDDNKIRALTLQLERLTLECNQKRKILDNELTETISAQLELDKAAQDFRKIHNERQELIKQWENTIEQMQKRDGDIDNCALELARIKQETREKENLVKEKIKFLESEIGNNTEFEKRISVADRKLLKCRTAYQDHETSRIQLKGELDSLKATVNRTSSDLEALRKNISKIKKDIHEETARLQKTKNHNEIIQTKLKEITEKTMSVEEKATNLEDMLKEEEKDVKEVDVQLNLIKGVLFKKAQELQTETMKEKAVLSEIEGTRSSLKHLNHQLQKLDFETLKQQEIMYSQDFHIQQVERRMSRLKGEINSEEKQALEAKIVELRKSLEEKKSTCGLLETQIKKLHNDLYFIKKAHSKNSDEKQSLMTKINELNLFIDRSEKELDKAKGFKQDLMIEDNLLKLEVKRTREMLHSKAEEVLSLEKRKQQLYTAMEERTEEIKVHKTMLASQIRYVDQERENISTEFRERLSKIEKLKNRYEILTVVMLPPEGEEEKTQAYYVIKAAQEKEELQREGDCLDAKINKAEKEIYALENTLQVLNSCNNNYKQSFKKVTPSSDEYELKIQLEEQKRAVDEKYRYKQRQIRELQEDIQSMENTLDVIEHLANNVKEKLSEKQAYSFQLSKETEEQKPKLERVTKQCAKLTKEIRLLKDTKDETMEEQDIKLREMKQFHKVIDEMLVDIIEENTEIRIILQTYFQQSGLELPTASTKGSRQSSRSPSHTSLSARSSRSTSTSTSQSSIKVLELKFPASSSLVGSPSRPSSASSSSSNVKSKKSSK

SEQ ID NO: 805793 - protein, 91 aa, Homo sapiens
MQENLAPWGELATDNIILTVPTTNLQALKDPEPVLRLWDEMMQAVARLAAEPFPFRRPERIVADVQISAGGCSQGILPERADTQGLTDRLS

SEQ ID NO: 805794 - protein, 191 aa, Homo sapiens
ENGNLEKSCLAKLRVDGAAFLQIPAEGVPAYISLHRLLRKMLRGSGLPAVSQENPVASDSYEAAVLSLATGLAHSGTDCSQLAQGLGTWTCSSSLYPSKHPITVEINGINPGNNDCWVSTGLYLLEGQNAEVSLSEAAASAGLRVRSEHPHLPPLKTVELCHSHPLSSSSSWQCCQEYRDGLFCPFYRFYR

SEQ ID NO: 805795 - protein, 140 aa, Homo sapiens
MDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGGCSQGILPERADTRD

SEQ ID NO: 805796 - protein, 140 aa, Homo sapiens; identical to SEQ ID NO: 805795

SEQ ID NO: 805797 - protein, 311 aa, Homo sapiens
ENGNLEKSCLAKLRVDGAAFLQIPAEGVPAYISLHRLLRKMLRGSGLPAVSQENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGGCSQGILPERADTRD

SEQ ID NO: 805798 - protein, 111 aa, Homo sapiens
LQIPAEGVPAYISLHRLLRKMLRGSGLPAVSQENPVASDSYEAAVLSLATGLAHSGTDCSQLAQGLGTWTCSSSLYPSKHPITVEINGINPGMKTGESAQNIKDVGESGIG

SEQ ID NO: 805799 - protein, 120 aa, Homo sapiens
RPRPLGSIAAQEGLEQLLRLSTPRATLPGARSRPQAHGHVGPQESQSSVGAGFPIRVLRRERGPLLREPHRARPPAASVSLATGTRPGLTPLLPSYWARTPGPAPSRLISTYRGGDRMAT

SEQ ID NO: 805800 - protein, 67 aa, Homo sapiens
RVVWWRAGHMGWNDEVRPQRRPPSSAAPSSCLLGLTPSSGHKDSAPPTPAALAPALEGAHFDLSEIV

SEQ ID NO: 805801 - protein, 105 aa, Homo sapiens
AAAGTGRAARRGPSPPSERSAPPSPPTFNGAGARLRPPAVGSSVQSRVESPVPALVDLCSRKGGCRGSAPGQDRCLSGPSVCILGDVGADLVVSWFMTPKRAGGG

SEQ ID NO: 805802 - protein, 101 aa, Homo sapiens
RAAARVGATRGPSRVRRRRGAPGRPGQLMVVAETSQGSWSAPTSPSTSCPPPNTTTTLAPLPHDRLDPPACQPVSVLHHWHMDCVCHGCDEPPCMPCGELV

SEQ ID NO: 805803 - protein, 271 aa, Homo sapiens
MTAWILLPVSLSAFSITGIWTVYAMAVMNHHVCPVENWSYNESCPPDPAEQGGPKTCCTLDDVPLISKCGSYPPESCLFSLIGNMGAFMVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 805804 - protein, 271 aa, Homo sapiens; identical to SEQ ID NO: 805803

SEQ ID NO: 805805 - protein, 187 aa, Homo sapiens
MGAFMVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 805806 - protein, 271 aa, Homo sapiens; identical to SEQ ID NO: 805803

SEQ ID NO: 805807 - protein, 187 aa, Homo sapiens; identical to SEQ ID NO: 805805

SEQ ID NO: 805808 - protein, 187 aa, Homo sapiens; identical to SEQ ID NO: 805805

SEQ ID NO: 805809 - protein, 224 aa, Homo sapiens
MRDPGSSHKSVACLLRSRCSKCGSYPPESCLFSLIGNMGAFMVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 805810 - protein, 187 aa, Homo sapiens; identical to SEQ ID NO: 805805

SEQ ID NO: 805811 - protein, 218 aa, Homo sapiens
MYALWRTGPTTSPALLTLLSKGVPRPAAPWTMSPSSVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 805812 - protein, 187 aa, Homo sapiens
MSPSSVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 805813 - protein, 210 aa, Homo sapiens
MTAWILLPVSLSAFSITGIWTVYAMAVMNHHVCPVENWSYNESCPPDPAEQGGPKTCCTLDDVPLISKCGSYPPESCLFSLIGNMGAFMVALICLLRYGQLLEQSRHSWVNTTALITGCTNAAGLLVVGNFQVESSLSMRVLSCNMGQPCVSGCVSSISSFSMAPSATSLGQSPQTHWWLHCSLPLAGPASPPGAAAPPPTSTVPPRASL

SEQ ID NO: 805814 - protein, 186 aa, Homo sapiens
RAAARVGATRGPSRVRRRRGAPGRPGQLMVVAETSQGPTTSPALLTLLSKGVPRPAAPWTMSPSSVALICLLRYGQLLEQSRHSWVNTTALITGCTNAAGLLVVGNFQVESSLSMRVLSCNMGQPCVSGCVSSISSFSMAPSATSLGQSPQTHWWLHCSLPLAGPASPPGAAAPPPTSTVPPRASL

SEQ ID NO: 805815 - protein, 271 aa, Homo sapiens; identical to SEQ ID NO: 805803

SEQ ID NO: 805816 - protein, 96 aa, Homo sapiens
CCQVSVCPTEHFLSLVCGVFFVHESSQLQHGAALCEWVCVIDILIFYGTFSYEFGAVSSDTLVAALQPTPGRACKSSGSSSTSTHLNCAPESIAMI

SEQ ID NO: 805817 - protein, 538 aa, Homo sapiens
MTRECPSPAPGPGAPLSGSVLAEAAVVFAVVLSIHATVWDRYSWCAVALAVQAFYVQYKWDRLLQQGSAVFQFRMSANSGLLPASMVMPLLGLVMKERCQTAGNPFFERFGIVVAATGMAVALFSSVLALGITRPVPTNTCVILGLAGGVIIYIMKHSLSVGEVIEVLEVLLIFVYLNMILLYLLPRCFTPGEALLVLGGISFVLNQLIKRSLTLVESQGDPVDFFLLVVVVGMVLMGIFFSTLFVFMDSGTWASSIFFHLMTCVLSLGVVLPWLHRLIRRNPLLWLLQFLFQTDTRIYLLAYWSLLATLACLVVLYQNAKRSSSESKKHQAPTIARKYFHLIVVATYIPGIIFDRPLLYVAATVCLAVFIFLEYVRYFRIKPLGHTLRSFLSLFLDERDSGPLILTHIYLLLGMSLPIWLIPRPCTQKGSLGGARALVPYAGVLAVGVGDTVASIFGSTMGEIRWPGTKKTFEGTMTSIFAQIISVALILIFDSGVDLNYSYAWILGSISTVSLLEAYTTQIDNLLLPLYLLILLMA

SEQ ID NO: 805818 - protein, 538 aa, Homo sapiens; identical to SEQ ID NO: 805817

SEQ ID NO: 805819 - protein, 538 aa, Homo sapiens; identical to SEQ ID NO: 805817

SEQ ID NO: 805820 - protein, 335 aa, Homo sapiens
MTRECPSPAPGPGAPLSGSVLAEAAVVFAVVLSIHATVWDRYSWCAVALAVQAFYVQYKWDRLLQQGSAVFQFRMSANSGLLPASMVMPLLGLVMKERCQTAGNPFFERFGIVVAATGMAVALFSSVLALGITRPVPTNTCVILGLAGGVIIYIMKHSLSVGEVIEVLEVLLIFVYLNMILLYLLPRCFTPGEALLVLGGISFVLNQLIKRSLTLVESQGDPVDFFLLVVVVGMVLMGIFFSTLFVFMDSGTWASSIFFHLMTCVLSLGVVLPWLHRLIRRNPLLWLLQFLFQTDTRIYLLAYWSLLATLACLVVLYQNAKRSSSESHSGSSRSQ

SEQ ID NO: 805821 - protein, 86 aa, Homo sapiens
GTRGRLAQTQRVAGVGAHWEPTERGGGSGAEFPTTRMAVTGAGSGARLSLPRGSSDSTRVAARPWQRPSSRGWELHRVPPRPGEDA

SEQ ID NO: 805822 - protein, 86 aa, Homo sapiens; identical to SEQ ID NO: 805821

SEQ ID NO: 805823 - protein, 231 aa, Homo sapiens
FVLRLAGDLPQRGLVHAAHSDGEQLDAAGPGPRRHVLHAVLGPPVCHHDDHLRHAGRCDTGLPEAHGTVQERRLRPGEAGGLPGRTARRHPGEEDPAGRRGDPFPLTERRGWGAFHLLRLPRAGSSEMPGGMRCPIAKLGSLSYEMATSRGIMGIKVSAGKAHNSEREPPNSSILAGWRARTLLMSGDLERPPSASPKALVIANWMARPVMVPVDSGWIRRTACSSAALET

SEQ ID NO: 805824 - protein, 108 aa, Homo sapiens
TLIGRFLSFRSLSRGDLSLELLSLSHDAKSWSLNLSFEDLLLDRSLLLSLELCRLLWWLRLRLRLLERDLWRWRFSRDLDRVLLLRSRDMERDRCLRCSLDLDLPDKI

SEQ ID NO: 805825 - protein, 86 aa, Homo sapiens
TPLPGDSGDALPGDCGRPRQEGAWQPKAMAGHPKEKVIPDEVHQNQILRELYLKELRTQKLYTQYHVNPLRKSESSYSHQEAHVLA

SEQ ID NO: 805826 - protein, 86 aa, Homo sapiens; identical to SEQ ID NO: 805825

SEQ ID NO: 805827 - protein, 94 aa, Homo sapiens
ARLRGRRTLRARCGISSRGAPFKPVGKAQYSGGSDPIFQFIQSPGSPCLGMITWRNLQMINPERHDRRLNHFRVCSDITLYKAKTWGLGDDHHK

SEQ ID NO: 805828 - protein, 86 aa, Homo sapiens; identical to SEQ ID NO: 805825

SEQ ID NO: 805829 - protein, 86 aa, Homo sapiens; identical to SEQ ID NO: 805825

SEQ ID NO: 805830 - protein, 107 aa, Homo sapiens [sequence omitted]

SEQ ID NO: 805831 - protein, 107 aa, Homo sapiens [sequence omitted]

SEQ ID NO: 805832 - protein, 133 aa, Homo sapiens
MPHPGPWQRTWKRTAEDLLQCMEMGAKLYRAFSTSRLKEFQGTEVKLLRHGRLRAGADILVVEPGGDKEQPGWGAADGQGAQWAPATPPCNSSPVPGATVLPPPPQPRCLRQATPDAAFTGNGLTSPVTLAGG

SEQ ID NO: 805833 - protein, 621 aa, Homo sapiens
RAAVPSPPRPRPPPPSRAPGRRRRRRRRRRLEQPGRRRRREWQRRRGRGGDERPRPRAQGGTAGVGGGPDAGPRGAMGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 805834 - protein, 564 aa, Homo sapiens
RAAVPSPPRPRPPPPSRAPGRRRRRRRRRRLEQPGRRRRREWQRRRGRGGDERPRPRAQGGTAGVGGGPDAGPRGAMGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGKQRVCRCCIGPQKAKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 805835 - protein, 548 aa, Homo sapiens
RAAVPSPPRPRPPPPSRAPGRRRRRRRRRRLEQPGRRRRREWQRRRGRGGDERPRPRAQGGTAGVGGGPDAGPRGAMGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 805836 - protein, 574 aa, Homo sapiens
RALQCLPHLGPARPRRAEHQGGGGGGGGGGGWSSPGGGGGENGSGVVGAAEMSARDPGPRAAQPEWAGVPMQARGGPWGRSCRSSPTAIPGLGHFCDSDSLKLLRVFDSFPLAEEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 805837 - protein, 491 aa, Homo sapiens
HRRQRKLSPPPRSGGDGGSLTRRTWTKQGGEEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 805838 - protein, 548 aa, Homo sapiens; identical to SEQ ID NO: 805835

SEQ ID NO: 805839 - protein, 564 aa, Homo sapiens; identical to SEQ ID NO: 805834

SEQ ID NO: 805840 - protein, 661 aa, Homo sapiens
RAAVPSPPRPRPPPPSRAPGRRRRRRRRRRLEQPGRRRRREWQRRRGRGGDERPRPRAQGGTAGVGGGPDAGPRGAMGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGELEKAVRGKWGLGVWWGTGLQMELFISWEHPDAPISVPTGVIGLFTIPLLYRQHQAQIDQYVGLVTNQLSHIKAKIRAKIPGTGALASAAAAVSGSKAKAE

SEQ ID NO: 805841 - protein, 537 aa, Homo sapiens
RAAVPSPPRPRPPPPSRAPGRRRRRRRRRRLEQPGRRRRREWQRRRGRGGDERPRPRAQGGTAGVGGGPDAGPRGAMGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKE

SEQ ID NO: 805842 - protein, 439 aa, Homo sapiens
RAAVPSPPRPRPPPPSRAPGRRRRRRRRRRLEQPGRRRRREWQRRRGRGGDERPRPRAQGGTAGVGGGPDAGPRGAMGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKGSDRPICGVGDQSVEPHQS

SEQ ID NO: 805843 - protein, 621 aa, Homo sapiens; identical to SEQ ID NO: 805833

SEQ ID NO: 805844 - protein, 565 aa, Homo sapiens
RAAVPSPPRPRPPPPSRAPGRRRRRRRRRRLEQPGRRRRREWQRRRGRGGDERPRPRAQGGTAGVGGGPDAGPRGAMGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGELGRP

SEQ ID NO: 805845 - protein, 539 aa, Homo sapiens
RAAVPSPPRPRPPPPSRAPGRRRRRRRRRRLEQPGRRRRREWQRRRGRGGDERPRPRAQGGTAGVGGGPDAGPRGAMGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKVAWSSQPLLGSPIHLCMARGWEGDCWVNSQHEREFPVGSADPDLHPQLALLFYILTFVGAIFNGLTLLILGELGRP

SEQ ID NO: 805846 - protein, 443 aa, Homo sapiens
SHGLAGKRPWWVCGGRGSLPGLSPPARSARPPRLQKLGLRVRRGRKPEATAQSSLSAVMWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLATADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 805847 - protein, 443 aa, Homo sapiens; identical to SEQ ID NO: 805846

SEQ ID NO: 805848 - protein, 318 aa, Homo sapiens
AHGLAGKRPWWVCGGRGSLPGLSPPARSARPPRLQKLGLRVRRGRKPEATAQSSLSAVMWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLATADLLLALALPPRIAYHLRGQRWPFGEAACRLATAALYGHMYGSVLLLAAVSLDRYLALLAMLLCYGATLHTLAASGRRYGHALRLTAVVLASAVAFFKHSQQPPAARRQAWDGLSLTASRGNQPCHHLDPGLLACRTVRP

SEQ ID NO: 805849 - protein, 291 aa, Homo sapiens
MALAARLLPQFLHSRSLPCGAVRLRTPAVAEVRLPSATLCYFCRCRLGLGAALFPRSARALAASALPAQGSRWPVLSSPGLPAAFASFPACPQRSYSTEEKPQQHQKTKMIVLGFSNPINWVRTRIKAFLIWAYFDKEFSITEFSEGAKQAFAHVSKLLSQCKFDLLEELVAKEVLHALKEKVTSLPDNHKNALAANIDEIVFTSTGDISIYYDEKGRKFVNILMCFWYLTSANIPSETLRGASVFQVKLGNQNVETKQLLSASYEFQREFTQGVKPDWTIARIEHSKLLE

SEQ ID NO: 805850 - protein, 130 aa, Homo sapiens
VVNRRGTCIDRKGNSQLADQNIKMPWSDTHNIKVATKACKRAPTSPLTIYDEKAQRRKFVNILMCFWYLTSANIPSETLRGASVFQVKLGNQNVETKQLLSASYEFQREFTQGVKPDWTIARIEHSKLLE

SEQ ID NO: 805851 - protein, 291 aa, Homo sapiens; identical to SEQ ID NO: 805849

SEQ ID NO: 805852 - protein, 225 aa, Homo sapiens
MALAARLLPQFLHSRSLPCGAVRLRTPAVAEVRLPSATLCYFCRCRLGLGAALFPRSARALAASALPAQGSRWPVLSSPGLPAAFASFPACPQRSYSTEEKPQQHQKTKMIVLGFSNPINWVRTRIKAFLIWAYFDKEFSITEFSEGAKQAFAHVSKLLSQCKFDLLEELVAKEVLHALKEKVTSLPDNHKNALAANIDEIVFTSTGDISIYYDEKGFRGSSHKE

SEQ ID NO: 805853 - protein, 365 aa, Homo sapiens
MPDVELNLKSPKVKGDLDIAGPNLEGDFKGPKVDIKAPEVNLNAPDVDVHGPDWNLKMPKMKMPKFSVSGLKAEGPDVAVDLPKGDINIEGPSMNIEGPDLNVEGPEGGLKGPKFKMPDMNIKAPKISMPDIDLNLKGPKVKGDVDISLPKLEGDLKGPEVDIKGPKVDINAPDVDVHGPDWHLKMPKVKMPKFSMPGFKGEGPEVDVTLPKADIDISGPNVDVDVPDVNIEGPDAKLKGPKFKMPEMNIKAPKISMPDFDLNLKGPKMKGDVVVSLPKVEGDLKGPEVDIKGPKVDIDTPDINIEGSEGKFKGPKFKIPEMHLKAPKISMPDIDLNLKGPKVKGDVDVSLPKMEGDLKGPEVDI

SEQ ID NO: 805854 - protein, 1884 aa, Homo sapiens
SGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKVDQLQQDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALTINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDRVTAGPRPPVSSGNLESSTQSASPFHRWGQTPAPQRHSGRVVGAHRPGLLSPVFVYSPAFQSGGEEGLWMSNTCTLR

SEQ ID NO: 805855 - protein, 81 aa, Homo sapiens
SEAALAGGFPTPGTLQATGPVAPSSARGPVPTCCRGCCKIKPHLQGHSRASASCEQREPGKQHPERQPVPQMGPDSGPSET

SEQ ID NO: 805856 - protein, 112 aa, Homo sapiens
GRGRGCCCRAAQTGRPVSFLSYNRFLKVCFCFCWFPGESGPAVAPEEGAAIARCGCDHDCGAQGNPVCGSDGVVYASACRLREAACRQAAPLEPAPPSCCALAGREAEWSRP

SEQ ID NO: 805857 - protein, 1613 aa, Homo sapiens
LKREEKKDFLPRNMDFGIVSTSGTLRFLFCCGITNMSFPLSDQPVLGEWFIFVEMQGHAYNKSFEVQKYVLPKFELLIDPPRYIQDLDACETGTVRARYTFGKPVAGALTINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALAGREAEWSRP

SEQ ID NO: 805858 - protein, 1072 aa, Homo sapiens
MTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALAGREAEWSRP

SEQ ID NO: 805859 - protein, 1660 aa, Homo sapiens
LKREEKKDFLPRNMDFGIVSTSGTLRFLFCCGITNMSFPLSDQPVLGEWFIFVEMQGHAYNKSFEVQKYVLPKFELLIDPPRYIQDLDACETGTVRARYTFGKPVAGALTINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDSQSGFSS

SEQ ID NO: 805860 - protein, 4355 aa, Homo sapiens
MSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAALAEAQDIHVHLIPLQRHLEALENAEFPEVKPQLRPLLHVVCLIWATCKSYRSPGRLTVLLQEICNLLIQQASNYLSPEDLLRSEVEESQRKLQVVSDTLSFFKQEFQDRRENLHTYFKENQEVKEWDFQSSLVFVRLDGFLGRLHVVEGLLKTALDFHKLGKVEFSGVRGNALSQQVQQMHEEFQEMYRLLSGSSSDCLYLQSTDFENDVSEFNQKVEDLDRRLGTIFIQAFDDAPGLEHAFKLLDIAGNLLERPLVARDTSDKYLVLIQMFNKDLDAVRMIYSQHVQEEAELGFSPVHKNMPTVAGGLRWAQELRQRIQGPFSNFGRITHPCMESAEGKRMQQKYEDMLSLLEKYETRLYEDWCRTVSEKSQYNLSQPLLKRDPETKEITINFNPQLISVLKEMSYLEPREMKHMPETAAAMFSSRDFYRQLVANLELMANWYNKVMKTLLEVEFPLVEEELQNIDLRLRAAEETLNWKTEGICDYVTEITSSIHDLEQRIQKTKDNVEEIQNIMKTWVTPIFKTKDGKRESLLSLDDRHDRMEKYYNLIKESGLKIHALVQENLGLFSADPTSNIWKTYVNSIDNLLLNGFFLAIECSLKYLLENTECKAGLTPIFEAQLSLAIPELVFYPSLESGVKGGFCDIVEGLITSIFRIPSLVPRLSPQNGSPHYQVDLDGIPDLANMRRTLMERVQRMMGLCCGYQSTFSQYSYLYVEDRKEVLGQFLLYGHILTPEEIEDHVEDGIPENPPLLSQFKVQIDSYETLYEEVCRLEPIKVFDGWMKIDIRPFKASLLNIIKRWSLLFKQHLVDHVTHSLANLDAFIKKSESGLLKKVEKGDFQGLVEIMGHLMAVKERQSNTDEMFEPLKQTIELLKTYEQELPETVFKQLEELPEKWNNIKKVAITVKQQVAPLQANEVTLLRQRCTAFDAEQQQFWEQFHKEAPFRFDSIHPHQMLDARHIEIQQMESTMASISESASLFEVNVPDYKQLRQCRKEVCQLKELWDTIGMVTSSIHAWETTPWRNINVEAMELECKQFARHIRNLDKEVRAWDAFTGLESTVWNTLSSLRAVAELQNPAIRERHWRQLMQATGVSFTMDQDTTLAHLLQLQLHHYEDEVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANITHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQNIHLVAKWLSTLEKKLEEHSENSHPEFRVFMSAEPAPSPEGHIIPQGILENSIKITNEPPTGMHANLHKALDNFTQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEF

SEQ ID NO: 805861 - protein, 4355 aa, Homo sapiens; identical to SEQ ID NO: 805860

SEQ ID NO: 805862 - protein, 798 aa, Homo sapiens
MNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQNIHLVAKWLSTLEKKLEEHSENSHPEFRVFMSAEPAPSPEGHIIPQGILENSIKITNEPPTGMHANLHKALDNFTQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 805863 - protein, 4365 aa, Homo sapiens
MSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAALAEAQDIHVHLIPLQRHLEALENAEFPEVKPQLRPLLHVVCLIWATCKSYRSPGRLTVLLQEICNLLIQQASNYLSPEDLLRSEVEESQRKLQVVSDTLSFFKQEFQDRRENLHTYFKENQEVKEWDFQSSLVFVRLDGFLGRLHVVEGLLKTALDFHKLGKVEFSGVRGNALSQQVQQMHEEFQEMYRLLSGSSSDCLYLQSTDFENDVSEFNQKVEDLDRRLGTIFIQAFDDAPGLEHAFKLLDIAGNLLERPLVARDTSDKYLVLIQMFNKDLDAVRMIYSQHVQEEAELGFSPVHKNMPTVAGGLRWAQELRQRIQGPFSNFGRITHPCMESAEGKRMQQKYEDMLSLLEKYETRLYEDWCRTVSEKSQYNLSQPLLKRDPETKEITINFNPQLISVLKEMSYLEPREMKHMPETAAAMFSSRDFYRQLVANLELMANWYNKVMKTLLEVEFPLVEEELQNIDLRLRAAEETLNWKTEGICDYVTEITSSIHDLEQRIQKTKDNVEEIQNIMKTWVTPIFKTKDGKRESLLSLDDRHDRMEKYYNLIKESGLKIHALVQENLGLFSADPTSNIWKTYVNSIDNLLLNGFFLAIECSLKYLLENTECKAGLTPIFEAQLSLAIPELVFYPSLESGVKGGFCDIVEGLITSIFRIPSLVPRLSPQNGSPHYQVDLDGIPDLANMRRTLMERVQRMMGLCCGYQSTFSQYSYLYVEDRKEVLGQFLLYGHILTPEEIEDHVEDGIPENPPLLSQFKVQIDSYETLYEEVCRLEPIKVFDGWMKIDIRPFKASLLNIIKRWSLLFKQHLVDHVTHSLANLDAFIKKSESGLLKKVEKGDFQGLVEIMGHLMAVKERQSNTDEMFEPLKQTIELLKTYEQELPETVFKQLEELPEKWNNIKKVAITVKQQVAPLQANEVTLLRQRCTAFDAEQQQFWEQFHKEAPFRFDSIHPHQMLDARHIEIQQMESTMASISESASLFEVNVPDYKQLRQCRKEVCQLKELWDTIGMVTSSIHAWETTPWRNINVEAMELECKQFARHIRNLDKEVRAWDAFTGLESTVWNTLSSLRAVAELQNPAIRERHWRQLMQATGVSFTMDQDTTLAHLLQLQLHHYEDEVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANITHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSK

SEQ ID NO: 805864 - protein, 1486 aa, Homo sapiens
LEYSSTFTMVERGHPEFLGKKPRSGSLVPSDSAALYLCIRSCHLFCSTELGPQVMPNRPVTSPVPTVPPVTTPDKSRASPMQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQNIHLVAKWLSTLEKKLEEHSENSHPEFRVFMSAEPAPSPEGHIIPQGILENSIKITNEPPTGMHANLHKALDNFTQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 805865 - protein, 3633 aa, Homo sapiens
MRLAEERAALAAENADGEPGADRRLRLLGTYVAMSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAALAEAQDIHVHLIPLQRHLEALENAEFPEVKPQLRPLLHVVCLIWATCKSYRSPGRLTVLLQEICNLLIQQASNYLSPEDLLRSEVEESQRKLQVVSDTLSFFKQEFQDRRENLHTYFKENQEVKEWDFQSSLVFVRLDGFLGRLHVVEGLLKTALDFHKLGKVEFSGVRGNALSQQVQQMHEEFQEMYRLLSGSSSDCLYLQSTDFENDVSEFNQKVEDLDRRLGTIFIQAFDDAPGLEHAFKLLDIAGNLLERPLVARDTSDKYLVLIQMFNKDLDAVRMIYSQHVQEEAELGFSPVHKNMPTVAGGLRWAQELRQRIQGPFSNFGRITHPCMESAEGKRMQQKYEDMLSLLEKYETRLYEDWCRTVSEKSQYNLSQPLLKRDPETKEITINFNPQLISVLKEMSYLEPREMKHMPETAAAMFSSRDFYRQLVANLELMANWYNKVMKTLLEVEFPLVEEELQNIDLRLRAAEETLNWKTEGICDYVTEITSSIHDLEQRIQKTKDNVEEIQNIMKTWVTPIFKTKDGKRESLLSLDDRHDRMEKYYNLIKESGLKIHALVQENLGLFSADPTSNIWKTYVNSIDNLLLNGFFLAIECSLKYLLENTECKAGLTPIFEAQLSLAIPELVFYPSLESGVKGGFCDIVEGLITSIFRIPSLVPRLSPQNGSPHYQVDLDGIPDLANMRRTLMERVQRMMGLCCGYQSTFSQYSYLYVEDRKEVLGQFLLYGHILTPEEIEDHVEDGIPENPPLLSQFKVQIDSYETLYEEVCRLEPIKVFDGWMKIDIRPFKASLLNIIKRWSLLFKQHLVDHVTHSLANLDAFIKKSESGLLKKVEKGDFQGLVEIMGHLMAVKERQSNTDEMFEPLKQTIELLKTYEQELPETVFKQLEELPEKWNNIKKVAITVKQQVAPLQANEVTLLRQRCTAFDAEQQQFWEQFHKEAPFRFDSIHPHQMLDARHIEIQQMESTMASISESASLFEVNVPDYKQLRQCRKEVCQLKELWDTIGMVTSSIHAWETTPWRNINVEAMELECKQFARHIRNLDKEVRAWDAFTGLESTVWNTLSSLRAVAELQNPAIRERHWRQLMQATGVSFTMDQDTTLAHLLQLQLHHYEDEVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANITHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKVRTEGRKCSATRACSVLHSGRGCRGGLFFLD

SEQ ID NO: 805866 - protein, 332 aa, Homo sapiens
MRLAEERAALAAENADGEPGADRRLRLLGTYVAMSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVADGTAISWPFEHQTRSTLIKIAKPAKSMIRSR

SEQ ID NO: 805867 - protein, 188 aa, Homo sapiens
MVERGHPEFLGKKPRSGSLVPSDSAALYLCIRSCHLFCSTELGPQVMPNRPVTSPVPTVPPVTTPDKSRASPMQVDDLKAKLAAQEVELKQKNEDADKLIQVVGVETDKVSREKAMADEEEQKVAVIMLEVKQKQKDCEEDLAKAEPALTAAQAALNTLNKVGGLSAIPAHPSGAGRRRDHLGIPKRC

SEQ ID NO: 805868 - protein, 736 aa, Homo sapiens
TSASCAAASGCFRIWYLGRAPRGSLSSLHRICLSPVHRILRGVPSKKNGLCCCCVWVPSPDASAARVMWTLVGRGWGCARALAPRATGAALLVAPGPRSAPTLGAAPESWATDRLYSSAEFKEKPDMSRFPVENIRNFSIVAHVDHGKSTLADRLLELTGTIDKTKNNKQVLDKLQVERERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLYAGQVGYLIAGMKDVTEAQIGDTLCLHKQPVEPLPGFKSAKPMVFAGMYPLDQSEYNNLKSAIEKLTLNDSSVTVHRDSSLALGAGWRLGFLGLLHMEVFNQRLEQEYNASVILTTPTVPYKAVLSSSKLIKEHREKEITIINPAQFPDKSKVTEYLEPVVLGTIITPDEYTGKIMMLCEARRAVQKNMIFIDQNRVMLKYLFPLNEIVVDFYDSLKSLSSGYASFDYEDAGYQTAELVKMDILLNGNTVEELVTVVHKDKAHSIGKAICERLKDSLPRQLFEIAIQAAIGSKIIARETVKAYRKNVLAKCYGGDITRKMKLLKRQAEGKKKLRKIGNVEVPKDAFIKVLKTQSSK

SEQ ID NO: 805869 - protein, 736 aa, Homo sapiens; identical to SEQ ID NO: 805868

SEQ ID NO: 805870 - protein, 736 aa, Homo sapiens; identical to SEQ ID NO: 805868

SEQ ID NO: 805871 - protein, 736 aa, Homo sapiens; identical to SEQ ID NO: 805868

SEQ ID NO: 805872 - protein, 736 aa, Homo sapiens; identical to SEQ ID NO: 805868

SEQ ID NO: 805873 - protein, 669 aa, Homo sapiens
DVGKLRRRFGLLPDLVLGQSSPGFIVFASQDLFESCPPDPTGGTFEKKRAMLLLREKPDMSRFPVENIRNFSIVAHVDHGKSTLADRLLELTGTIDKTKNNKQVLDKLQVERERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLYAGQVGYLIAGMKDVTEAQIGDTLCLHKQPVEPLPGFKSAKPMVFAGMYPLDQSEYNNLKSAIEKLTLNDSSVTVHRDSSLALGAGWRLGFLGLLHMEVFNQRLEQEYNASVILTTPTVPYKAVLSSSKLIKEHREKEITIINPAQFPDKSKVTEYLEPVVLGTIITPDEYTGKIMMLCEARRAVQKNMIFIDQNRVMLKYLFPLNEIVVDFYDSLKSLSSGYASFDYEDAGYQTAELVKMDILLNGNTVEELVTVVHKDKAHSIGKAICERLKDSLPRQLFEIAIQAAIGSKIIARETVKAYRKNVLAKCYGGDITRKMKLLKRQAEGKKKLRKIGNVEVPKDAFIKVLKTQSSK

SEQ ID NO: 805874 - protein, 650 aa, Homo sapiens
DVGKLRRRFGLLPDLVLGQSSPGFIVFASQDLFESCPPDPTGGTFEKKRAMLLLREKPDMSRFPVENIRNFSIVAHVDHGKSTLADRLLELTGERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLYAGQVGYLIAGMKDVTEAQIGDTLCLHKQPVEPLPGFKSAKPMVFAGMYPLDQSEYNNLKSAIEKLTLNDSSVTVHRDSSLALGAGWRLGFLGLLHMEVFNQRLEQEYNASVILTTPTVPYKAVLSSSKLIKEHREKEITIINPAQFPDKSKVTEYLEPVVLGTIITPDEYTGKIMMLCEARRAVQKNMIFIDQNRVMLKYLFPLNEIVVDFYDSLKSLSSGYASFDYEDAGYQTAELVKMDILLNGNTVEELVTVVHKDKAHSIGKAICERLKDSLPRQLFEIAIQAAIGSKIIARETVKAYRKNVLAKCYGGDITRKMKLLKRQAEGKKKLRKIGNVEVPKDAFIKVLKTQSSK

SEQ ID NO: 805875 - protein, 717 aa, Homo sapiens
TSASCAAASGCFRIWYLGRAPRGSLSSLHRICLSPVHRILRGVPSKKNGLCCCCVWVPSPDASAARVMWTLVGRGWGCARALAPRATGAALLVAPGPRSAPTLGAAPESWATDRLYSSAEFKEKPDMSRFPVENIRNFSIVAHVDHGKSTLADRLLELTGERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLYAGQVGYLIAGMKDVTEAQIGDTLCLHKQPVEPLPGFKSAKPMVFAGMYPLDQSEYNNLKSAIEKLTLNDSSVTVHRDSSLALGAGWRLGFLGLLHMEVFNQRLEQEYNASVILTTPTVPYKAVLSSSKLIKEHREKEITIINPAQFPDKSKVTEYLEPVVLGTIITPDEYTGKIMMLCEARRAVQKNMIFIDQNRVMLKYLFPLNEIVVDFYDSLKSLSSGYASFDYEDAGYQTAELVKMDILLNGNTVEELVTVVHKDKAHSIGKAICERLKDSLPRQLFEIAIQAAIGSKIIARETVKAYRKNVLAKCYGGDITRKMKLLKRQAEGKKKLRKIGNVEVPKDAFIKVLKTQSSK

SEQ ID NO: 805876 - protein, 536 aa, Homo sapiens
FLLLLLIVYPSHCACSARMLCPCVESGSDRGEIHRRHTLISNIYVYCRFRRGAYRYIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLYAGQVGYLIAGMKDVTEAQIGDTLCLHKQPVEPLPGFKSAKPMVFAGMYPLDQSEYNNLKSAIEKLTLNDSSVTVHRDSSLALGAGWRLGFLGLLHMEVFNQRLEQEYNASVILTTPTVPYKAVLSSSKLIKEHREKEITIINPAQFPDKSKVTEYLEPVVLGTIITPDEYTGKIMMLCEARRAVQKNMIFIDQNRVMLKYLFPLNEIVVDFYDSLKSLSSGYASFDYEDAGYQTAELVKMDILLNGNTVEELVTVVHKDKAHSIGKAICERLKDSLPRQLFEIAIQAAIGSKIIARETVKAYRKNVLAKCYGGDITRKMKLLKRQAEGKKKLRKIGNVEVPKDAFIKVLKTQSSK

SEQ ID NO: 805877 - protein, 387 aa, Homo sapiens
TSASCAAASGCFRIWYLGRAPRGSLSSLHRICLSPVHRILRGVPSKKNGLCCCCVWVPSPDASAARVMWTLVGRGWGCARALAPRATGAALLVAPGPRSAPTLGAAPESWATDRLYSSAEFKEKPDMSRFPVENIRNFSIVAHVDHGKSTLADRLLELTGTIDKTKNNKQVLDKLQVERERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLNVSSRPI

SEQ ID NO: 805878 - protein, 387 aa, Homo sapiens; identical to SEQ ID NO: 805877

SEQ ID NO: 805879 - protein, 387 aa, Homo sapiens; identical to SEQ ID NO: 805877

SEQ ID NO: 805880 - protein, 387 aa, Homo sapiens; identical to SEQ ID NO: 805877

SEQ ID NO: 805881 - protein, 380 aa, Homo sapiens
TSASCAAASGCFRIWYLGRAPRGSLSSLHRICLSPVHRILRGVPSKKNGLCCCCVWVPSPDASAARVMWTLVGRGWGCARALAPRATGAALLVAPGPRSAPTLGAAPESWATDRLYSSAEFKEKPDMSRFPVENIRNFSIVAHVDHGKSTLADRLLELTGTIDKTKNNKQVLDKLQVERERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKL

SEQ ID NO: 805882 - protein, 129 aa, Homo sapiens
MSLAVWRHVGGVRALTGQPLGGPAYPSMNVANSSPLLCLLQGEGGLGTSAHKEKTAPVRVPPELPSPGPRLTSRLILTAHEAFVAFIFQQLKQIGEIQLSGAAGLPSAWDLCHLHMPWGQMWTNVGSRL

SEQ ID NO: 805883 - protein, 170 aa, Homo sapiens
RRAEFQGGWLSTSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVASAKRAHVQHVSPGEELSAGLSEAPRKKPVRPQKRCRFSLSLLLKGCSTVTDKQRHIKVILVSKSL

SEQ ID NO: 805884 - protein, 2198 aa, Homo sapiens
AANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQVGSLGEGRRGVRVLPVQRDRILSWAGGMHVSCSRVGSSILLRGDWHSNLLLNPKQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQFSSLKGPPVEGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 805885 - protein, 2142 aa, Homo sapiens
AANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGFSSLKGPPVEGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 805886 - protein, 1739 aa, Homo sapiens
MNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 805887 - protein, 1454 aa, Homo sapiens
IEHVIKEVYSKRPKPMSSDSSDSFFASTFFSSADYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 805888 - protein, 797 aa, Homo sapiens
GSEDPTCLMSLQRLCTKGVVRKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 805889 - protein, 117 aa, Homo sapiens
PRLCWVSGCGCLGRAVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 805890 - protein, 2183 aa, Homo sapiens
AANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGFSSLKGPPVEGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTPLTTVSHLCPLSLRVFTSHLDITAGHSHRDDTWVPIPALPLKHLRPPSSPFALGPWVSHPLMRWVQKLSHLHSNPGTGFSMGGKQQRN

SEQ ID NO: 805891 - protein, 2198 aa, Homo sapiens; identical to SEQ ID NO: 805884

SEQ ID NO: 805892 - protein, 2198 aa, Homo sapiens; identical to SEQ ID NO: 805884

SEQ ID NO: 805893 - protein, 2156 aa, Homo sapiens
AANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQVGSLGEGRRGVRVLPVQRDRILSWAGGMHVSCSRVGSSILLRGDWHSNLLLNPKQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQFSSLKGPPVEGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVGSEALPSSQQPWHWLLNGREAAEKLKC

SEQ ID NO: 805894 - protein, 2128 aa, Homo sapiens
AANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQVGSLGEGRRGVRVLPVQRDRILSWAGGMHVSCSRVGSSILLRGDWHSNLLLNPKQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQFSSLKGPPVEGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYL

SEQ ID NO: 805895 - protein, 2144 aa, Homo sapiens
AANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQVGSLGEGRRGVRVLPVQRDRILSWAGGMHVSCSRVGSSILLRGDWHSNLLLNPKQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQFSSLKGPPVEGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLRALVTLLLQSPVIDTQ

SEQ ID NO: 805896 - protein, 1230 aa, Homo sapiens
AANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQVGSLGEGRRGVRVLPVQRDRILSWAGGMHVSCSRVGSSILLRGDWHSNLLLNPKQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQFSSLKGPPVEGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLVMEEVVKWASTFLPAS

SEQ ID NO: 805897 - protein, 200 aa, Homo sapiens
TDMLLKVQNAIGELYLETGMTQEGFQYFQKAWSSMLHLSLSDLEDSRDLVKQKVRVLDNLAKSASEEYLKENHILEYATEISNLLDNNPRDQATMKYIEGVLMFVAGNTSLAKMKLRECLNIRKSLFGKKNMLVGEVMEFLVDLLFFPQRDSKKSQRKQVLKYYKQVIKIKENAETLAKSSLLRKQLSISLSDTLCKLAF

SEQ ID NO: 805898 - protein, 645 aa, Homo sapiens
MPRSRGGRAAPGPPPPPPPPGQAPRWSRWRVPGRLLLLLLPALCCLPGAARAAAAAAGAGNRAAVAVAVARADEAEAPFAGQNWLKSYGYLLPYDSRASALHSAKALQSAVSTMQQFYGIPVTGVLDQTTIEWMKKPRCGVPDHPHLSRRRRNKRYALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 805899 - protein, 645 aa, Homo sapiens; identical to SEQ ID NO: 805898

SEQ ID NO: 805900 - protein, 645 aa, Homo sapiens; identical to SEQ ID NO: 805898

SEQ ID NO: 805901 - protein, 645 aa, Homo sapiens; identical to SEQ ID NO: 805898

SEQ ID NO: 805902 - protein, 645 aa, Homo sapiens; identical to SEQ ID NO: 805898

SEQ ID NO: 805903 - protein, 645 aa, Homo sapiens; identical to SEQ ID NO: 805898

SEQ ID NO: 805904 - protein, 645 aa, Homo sapiens; identical to SEQ ID NO: 805898

SEQ ID NO: 805905 - protein, 38 aa, Homo sapiens
MAEEPREEEMRNTPSPGYSSFTSSANNKILHQPLGYHS

SEQ ID NO: 805906 - protein, 113 aa, Homo sapiens
PPALFPSRLQPTLRGPCALQRTRQPAHHAQLHLLQELWPPWEAGSRYLPTNLNNFERDLCSATSHRISGELGVSSLTHPPRDWSSVMCAMVMHHREETRVRGSPASKMRLVYR

SEQ ID NO: 805907 - protein, 324 aa, Homo sapiens
MAPRPRGSRSADEGCLLPFLLFLFIFFKGCQFWKLFLASQTTVARWSRERPRPGAFCCLAEGRARGVRGPQAQRVRGRVRRRSSPPFGTQKHGGSPRAALQGPREPAAWVTSGSLQAGGGCCRQARAWVRAVGIPRGQGRREPEETREGARGRGWPGMELARPQWGTRQGTRRSPGSASLPAHGRSEELEPPPRTRSRGRRLLPVAPVRPPSRRRQQRPLSHAPGPVGAGASWDGLAAACGYALFPERQHTHVSAVAPDPPRAAVLSVHTHYPGPSGRPAGLPPSRPAASWPKSSRDTPPGLLRTGLHPPPRTRSAPRSLRVLG

SEQ ID NO: 805908 - protein, 324 aa, Homo sapiens; identical to SEQ ID NO: 805907

SEQ ID NO: 805909 - protein, 324 aa, Homo sapiens; identical to SEQ ID NO: 805907

SEQ ID NO: 805910 - protein, 279 aa, Homo sapiens
MAPRPRGSRSADEGCLLPFLLFLFIFFKGCQFWKLFLASQTTVARWSRERPRPGAFCCLAEGRARGVRGPQAQRVRGRVRRRSSPPFGTQKHGGSPRAALQGPREPAAWVTSGSLQAGGGCCRQARAWVRAVGIPRGQGRREPEETREGARGRGWPGMELARPQWGTRQGTRRSPGSASLPAHGRSEELEPPPRTRSRGRRLLPVAPVRPPSRRRQQRPLSHAPGPVGAGASWDGLAAACGYALFPERQHTHVSAVAPDPPRAAVLSVHTHYPDISPQT

SEQ ID NO: 805911 - protein, 102 aa, Homo sapiens
PPALFPSRLQPTLRGPCALQRTRQPAHHAQLHLLQELWPPWEAGSRYLPTNLNNFERDLCSATSHRISGELGVSSLTHPPRDAALLSTLLRITRMTVLWLQP

SEQ ID NO: 805912 - protein, 265 aa, Homo sapiens
RRLGGHRVPRGPRGRGRGAAGRRRAGPSGDTAGRAAGSPDSAVSWATGLLRRGPRGSRWREAAVGGKGRAGPGAAPQVAAPGGARGRRGSRGGACSRPRRARPSRASFWIPARSRRGNSPGGHRSSGAGRPGSEGGREQAGGEGGQQQREQGRPGRRGRWGRTRRVRPRSPGRGGRLRRPLWGGGGGIFRDRTRRSLPLCAPFPCCPSRCALSRKAAHACLCRGPRSSPRRRFERSHSLPRSVWETRRAPALPARSLLAKILPGH

SEQ ID NO: 805913 - protein, 30 aa, Homo sapiens
MIVGGVEHFEPVLIVVVSKQVLEAPQADDL

SEQ ID NO: 805914 - protein, 1655 aa, Homo sapiens
MEEGKELGTREVAVERGREEGRWHMGPMLRNTGGGCGAGLCLGGTCFGSVFAELTPPWVSRAARQITTDRMWESRASERGRGSLDKLAHTRQMFAQKNTVKSSCKYNRESASSHPWLLCLLAFLSCAKGVEEGLGGRFWGPGEEVCSAYPCRPLPSSPQENSLFFANVTLKVSPGLRYPQSWCERGTQLSPSLLALCCPPSPPAPSRKVVGSPGDGTSFPGQSPCPPTVPVLDPFQCLPSPLSHTPQISGNPCGPQALDWGSLAGAWGEPGPPKLRWVAAKRHVAEAGKAASRGVPTPRWASSHPEVKDDGLRPISILTGQDPSLRTADLLPKRAGPRSCCQAGPPSPPSATAYMDREPQSPTVTLGTNCQARVTMVTEAGWEGLGRHEPSLLLNPLSGGGLTVCALFDVGWGGQKEGSGHCHGNMGAPLARGPGLDEQPRGDGLRKPSFPGWAAEIGAEIPRWGRAGGDTGHGDRQEVPHDSSSLQPSRHHSAPLPFCGGQGSRRTREAGAGSLHLRRPGSWPARHTPHSSQATWKTLEVGWWNVALPRLLSRQQDPLPSPGCRHRGQKPPRILNHSCTLWGHCMWLSRKKKHLPDSQVPQPQGTTASERDVGWAQGGQGSTRELQGVPGQHWAGKLGDLRLSCCVTLGLSTPFSGPQFPPLSKVEGDIALMSNAKSAGDLTPSLGRDPLPALEGLQSLSTPAFLTPTPVSSPRPPRPHTLSWLPSSPRQPPGPAHPSRVPGQHSKDDWFRYQFVNFKENVSLFSCPLLSDVGLFTVGWWSGVCVRACVRVCMCVLSWALAPESAPRPGRLDPSPKRPPALWLRPHQGGRGGSQLLLGGDPLPVIKDVMQILVLGELDLLAQGVTGGHVHLLPVVLLVGRKRSQILCVLSDEYSGLEEYPEYVVSGGELRVGGVTLGAGQRLEEGHALAQAVGTLLVVQGGKAVPVLAAVVGRLHLQVVDAPAPAAAPAAARRHQREPVQRAVEGAALLDVLGVALSQPCGGRMVGHVQAKDLGALDGTTGRHAAGLAGHGRVGAQLALYVGGGSSPCREAKGSWAAPGPRGQWLRRRQQLQGGTGTEGQLGVPTAAAASQKRGRVQLESIDAVVNDLVDLVHLLGNGGDLCSRALAVLEVREVILGPSQTVPAGACAHLDIVAFGGYLGCVQPGLQPLGGGQLLPDHGGDGGHARYGQHGRLAQLLGGVHNGAGIHISPVAHLQDGLLDVDRLLLLLLHAPLAQAVVHGSQHDNHAKEAAQDGHDVVGGGGGAGRQVSGDGVPRGEGQAGVVEAAAVAQRGHAEGVLSVRPQFVQRHDLLLVLEGHDVGEVAVVVLHEDVHLAVGVWDDDHQGGRGERDVVQLDGWPCRRIRGGRGRRLHRKDLVGVEARVLVWLPLGVGGVGRGVAHGPGGQRAIPTLGLEYGDGVEAVVGPGHQQRVAGKLPRRLTLQAVVVLGDVVEDHQPGQEAEEVALTVEGVAGQLTHHQAGEAGKGGTVQAAEAVGGQVDADEARALGEGGGRHHLDEVVLDKEELQAAHASQHALRQVAELVVAQLQDLQARLAQEGTVLDVGDLVLGEVEVGEVPKAVERGVEHGFELVLVEPQVVHGAIDVLRDGLVGRLVLAADGQPHVALVALNEPAVGTHGTRPAHAQQRRRAQPQAQHG

SEQ ID NO: 805915 - protein, 130 aa, Homo sapiens [sequence omitted]

SEQ ID NO: 805916 - protein, 149 aa, Homo sapiens
MLAWRGTWLTRPPHRWTSSQSLATGGLLAGETNIAGWSAKRVPRYGPADKWHSLRHSCGADREELQSIINTEPQQLSCALQETVAAGANDSSWMVTLTKTSSGGHRSPPGHVFKPKEKSQDGSELITVIAIQMTALSMAQLASILANAT

SEQ ID NO: 805917 - protein, 542 aa, Homo sapiens
TAKEGGNTGKGCLLPAGDRTMEPGGARLRLQRTEGLGGERERQPCGDGNTETHRAPDLVQWTRHMEAVKAQLLEQAQGQLRELLDRAMREAIQSYPSQDKPLPPPPPGSLSRTQEPSLGKQKVFIIRKSLLDELMEVQHFRTIYHMFIAGLCVFIISTLAIDFIDEGRLLLEFDLLIFSFGQLPLALVTWVPMFLSTLLAPYQALRLWARGTWTQATGLGCALLAAHAVVLCALPVHVAVEHQLPPASRCVLVFEQVRFLMKSYSFLREAVPGTLRARRGEGIQAPSFSSYLYFLFCPTLIYRETYPRTPYVRWNYVAKNFAQALGCVLYACFILGRLCVPVFANMSREPFSTRALVLSILHATLPGIFMLLLIFFAFLHCWLNAFAEMLRFGDRMFYRDWWNSTSFSNYYRTWNVVVHDWLYSYVYQDGLRLLGARARGVAMLGVFLVSAVAHEYIFCFVLGFFYPVMLILFLVIGGMLNFMMHDQRTGPAWNVLMWTMLFLGQGIQVSLYCQEWYARRHCPLPQATFWGLVTPRSWSCHT

SEQ ID NO: 805918 - protein, 413 aa, Homo sapiens
HKGGETAFTYRFLFRAKLLCLSKSAWASGPGSALQARLTRLMSCSPVSEAVMSLQRAWRAGLGRPKPRKKGRSYSEGPLHPKACHLPRGKNPKSLASVAFFRSSAQLDMCVCVCLGKGQRGLPGRWVEVGGVLTLPQSSRRGHTPRTQAAPPLVKHPASPWGWPHSFIGATAADDNGSSGQCLPDDLPSSREGAAPVGRRCLPSQMETAGKWHLFPPGVEMLVSGTPCHFSGHPPAPSWEIQHPHECGAQGHQLFHLLSARPVAPALHPQLTQQGLECAAALLEPVARVGGWEEDSRWQATGWGVQPEAHSGEEGLPARDAAHFVLHTLLGCVHGIALPILDALQGFLHLRGNWGKHWDAGAQASQTGGSVYSHQPGGNKPAWEDRRSALAVPQERGASKAHCPLGQGVSRRS

SEQ ID NO: 805919 - protein, 157 aa, Homo sapiens [sequence omitted]

SEQ ID NO: 805920 - protein, 78 aa, Homo sapiens
RTQPHSCSLQNKAKGAGILMRAAGNNPGSWVHTDCGEQRGGVEAAAAAQSLPRRSQVHRACATLGARGGAGLPPNPIC

SEQ ID NO: 805921 - protein, 413 aa, Homo sapiens; identical to SEQ ID NO: 805918

SEQ ID NO: 805922 - protein, 949 aa, Homo sapiens
MILSLLFSLGGPLGWGLLGAWAQASSTSLSDLQSSRTPGVWKAEAEDTSKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLDGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 805923 - protein, 166 aa, Homo sapiens
MILSLLFSLGGPLGWGLLGAWAQASSTSLSDLQSSRTPGVWKAEAEDTSKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGPPLLQ

SEQ ID NO: 805924 - protein, 849 aa, Homo sapiens
MAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLDGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 805925 - protein, 888 aa, Homo sapiens
MSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLDGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 805926 - protein, 763 aa, Homo sapiens
ASKLLLRGHQQLTSLLSAFNSPSLNLVIFPGLEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLDGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 805927 - protein, 453 aa, Homo sapiens
MILSLLFSLGGPLGWGLLGAWAQASSTSLSDLQSSRTPGVWKAEAEDTSKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMIL

SEQ ID NO: 805928 - protein, 246 aa, Homo sapiens
MASRGWVLNRHEAYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQG

SEQ ID NO: 805929 - protein, 157 aa, Homo sapiens
SLAHAQLVVELLADHASAGIALMGGHVGDLQEHGRHQVDTLQQLQVDVQVEGDLTAPLHLLLLLVALLQAAQQQALAQKLLGSATRLDVQQGVVCVLGQALAEGTDAQLHHGAVVKDSALALVPGPRPHAHEPLAGQHSACRPASADPLSRPILEST

SEQ ID NO: 805930 - protein, 308 aa, Homo sapiens
MFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQG

SEQ ID NO: 805931 - protein, 430 aa, Homo sapiens
MFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRKADQGRTQRPAGHPVEWRARSFWARACCCAACRSATRSRRRWQRRRQVPFHLHINLELLECVYLVSAMLLEIPYMAAHESDARRRMISKQFHHQLRVGERQPWWFPLSHAGHVVAAPRLVVTGP

SEQ ID NO: 805932 - protein, 308 aa, Homo sapiens; identical to SEQ ID NO: 805930

SEQ ID NO: 805933 - protein, 307 aa, Homo sapiens
EDDEDWDTGSTSSDSDSEEEEGKQTALASRFLKKAPTTDEDKKAAEKKTGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQG

SEQ ID NO: 805934 - protein, 246 aa, Homo sapiens; identical to SEQ ID NO: 805928

SEQ ID NO: 805935 - protein, 417 aa, Homo sapiens [sequence omitted]

SEQ ID NO: 805936 - protein, 1049 aa, Homo sapiens
MDWSFFRVVAVLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 805937 - protein, 399 aa, Homo sapiens
MTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 805938 - protein, 95 aa, Homo sapiens
CKMCLCSSFAFCHDCEASPAVWNSPVPQDLAYGLQLLTVLVVGGQQEAPVPAGPLPPAQDLRKIHLTPMWSWKERDLEDVLERILRNLRGPQTTL

SEQ ID NO: 805939 - protein, 85 aa, Homo sapiens
CKMCLCSSFAFCHDCEASPAVWNSPVPQDLAYGLQLLTVLVVGGQQEAPVPAGPLPPAQAPARWPSTHPSSTRGETPGASHNDNL

SEQ ID NO: 805940 - protein, 207 aa, Homo sapiens
MPGVLHLHVRALPRHREPAGLLAQRQIVPRGQSLVVCVSPFSPLWGSEPPALLLWVHQSPPRCPHADAHRPARGNTDMRTRRPTHRRTQSCTWRHVRTRRPTRRPTHRCTRTCTWRHRCVHMQAHTQVSVDLCEQMRADLHVETQTCRRTKRSLKADTQEGASHLWDSRDAVANTSVVPSSLLDKTEACSGHTWEAEPRDWAQEPFC

SEQ ID NO: 805941 - protein, 123 aa, Homo sapiens
QRVGDRKSLRGGRQSPAQPRAGIQAPPLRPSPGPAPMMKRASTGVLAVDIFDKFNFTGARVPWFDAIHEEFPRELESSISFPANFFKPPEEKEGPLVRPASRRTTPQTTRPGPGTEGEAPISR

SEQ ID NO: 805942 - protein, 161 aa, Homo sapiens
MKRASTGVLAVDIFDKFNFTGARVPWFDAIHEEFPRELESSISFPANFFKPPEEKVETGFHHIGQAGLDLLSLRIRPPPPPKVLGLQTKSSDDLLAGMARGVTVTNGVKGKESSCPSAAPSASAPAMTTVENKSKISTGTRRGCPFSPLLLDITQICKRKK

SEQ ID NO: 805943 - protein, 207 aa, Homo sapiens; identical to SEQ ID NO: 805940

SEQ ID NO: 805944 - protein, 207 aa, Homo sapiens; identical to SEQ ID NO: 805940

SEQ ID NO: 805945 - protein, 132 aa, Homo sapiens
RGAETRCRAGAGPERRRLDAGPGLGRRLAPAPKRLSVPDPLRLTPMMKRASTGVLAVDIFDKFNFTGARVPWFDAIHEEFPRELESSISFPANFFKPPEEKEGPLVRPASRRTTPQTTRPGPGTEGEAPISR

SEQ ID NO: 805946 - protein, 182 aa, Homo sapiens
FFSSILCLISIYLETSHSRPAFREQQGEGGKRGLPPGEARFPGVGTGEKQGRHEEGGGGRWRLRTGVGSAGSQDQAEDAAFPGVGLQRCPPGADEEPRARVQLAGEDLKQREAGGRVGKGFEKESFATGGVCTALLQKRPGRDQPQGDFKLKRKRLTDSHPDVSICSELRKRGRNFQHHVSV

SEQ ID NO: 805947 - protein, 409 aa, Homo sapiens
RGARPVKKSVAGRGHRWPQGKPSGHRAGRDPPSGGGGSSAGAHEGTMAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 805948 - protein, 309 aa, Homo sapiens
RGARPVKKSVAGRGHRWPQGKPSGHRAGRDPPSGGGGSSAGAHEGTMAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQAVDILKTERLGHGYHTLEDQALYNRLRQENMHFEICPGQDTQWCLKARNRHINTHAHNYKA

SEQ ID NO: 805949 - protein, 409 aa, Homo sapiens; identical to SEQ ID NO: 805947

SEQ ID NO: 805950 - protein, 409 aa, Homo sapiens; identical to SEQ ID NO: 805947

SEQ ID NO: 805951 - protein, 434 aa, Homo sapiens
RGARPVKKSVAGRGHRWPQGKPSGHRAGRDPPSGGGGSSAGAHEGTMAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEVGPGLAMGSLLTASSHTWLYSASLQAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 805952 - protein, 194 aa, Homo sapiens
MTWLSPFQEAVKSGIHRTVHAGEVGSAEVVKEVGPGLAMGSLLTASSHTWLYSASLQAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 805953 - protein, 261 aa, Homo sapiens
RGARPVKKSVAGRGHRWPQGKPSGHRAGRDPPSGGGGSSAGAHEGTMAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQVGPVRRNGEAGPG

SEQ ID NO: 805954 - protein, 93 aa, Homo sapiens
NINAAKSSFLPEDEKRELLDLLYKAYGMPPSASAGRFLSGLLGSCPVLAPVWLSVGLLARCPSILGQRHECVMTPWFLGPGWEQRLIRSVCFL

SEQ ID NO: 805955 - protein, 123 aa, Homo sapiens
LQTGLTTSSSDSGLRGDPLSLLSTGHRQNLALLPGLECSGTVSGIGGFLVSLTSRMKPRTLARWGFHHVGPAGLELLTSSDLPVSASQMAGITGTRHRAWPWEHVYMDFVHFLKQTEGNLLDL

SEQ ID NO: 805956 - protein, 102 aa, Homo sapiens
PGPAPPRQGCIMATLACRVQFLDDTDPFNSTNFPEPSRPPLFTFREDLALGTQLAGVHRLLQAPHKLDDCTLQLSHNGAYLDLEATLAEQRDELEGFQDDAG

SEQ ID NO: 805957 - protein, 143 aa, Homo sapiens
GRGGGGKRGGGRGPGEEGRLPLFPPLTFNLGTRCPGMQPAPRSEAAVGVPCAEGTQKPRGSLPRPHPPPRGDAPYGLGHLHPRTAAGFPSGCDPGEFAISVPPPPPHTAPSRLPVILGCTQRRVCGPGFDGNATREAGSPLLK

SEQ ID NO: 805958 - protein, 113 aa, Homo sapiens
DGSSADPAVPHWLRVPSPPFPEGSRHRRVMREGSPRQRQVAARAGVREGFASFLEVSANPKTSPCGVSEMVAEREGMGLFLPRSWRTDDKVPRSRGHPLIACRGRPSCGHGVS

SEQ ID NO: 805959 - protein, 128 aa, Homo sapiens
GRGGGGKRGGGRGPGEEGRLPLFPPLTFNLGTRCPGMQPAPRSEAAVGVPCAEGTQKPRGSLPRPHPPPRGDAPYGLGHLHPRTAAGFPSGCDPGGGKERGREGGRSEGGRQAGGEEREIRLLGGLLI

SEQ ID NO: 805960 - protein, 111 aa, Homo sapiens
GRGGGGKRGGGRGPGEEGRLPLFPPLTFNLGTRCPGMQPAPRSEAAVGVPCAEGTQKPRGSLPRPHPPPRGDAPYGLGHLHPRTAAGFPSGCDPGGFDGNATREAGSPLLK

SEQ ID NO: 805961 - protein, 71 aa, Homo sapiens
ASLPSQRSARAPPGCCGGGFPGTFQESASRDRGPRYCFKEARSQYTGFREDRSLPSPYHHHHHTQHPQDSL

SEQ ID NO: 805962 - protein, 71 aa, Homo sapiens; identical to SEQ ID NO: 805961

SEQ ID NO: 805963 - protein, 71 aa, Homo sapiens; identical to SEQ ID NO: 805961

SEQ ID NO: 805964 - protein, 1122 aa, Homo sapiens
QGLQRGDPPGRMHWLPAGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGGSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 805965 - protein, 136 aa, Homo sapiens
VRTKWDDLRKAAGLIPDPYSVPGPSQMALLPVTNIRAKSWGLSVNGIGHSKHHKSLEPLASPAVPFPGGQGKAKNSPSLGFHGRARRGALQSSVGPAEPTWAQGQSGTCCTPDTTQPSLARLTGQGPPQPSHVTVW

SEQ ID NO: 805966 - protein, 1149 aa, Homo sapiens
QGLQRGDPPGRMHWLPAGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEAFVPMRSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 805967 - protein, 271 aa, Homo sapiens
MCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 805968 - protein, 1122 aa, Homo sapiens; identical to SEQ ID NO: 805964

SEQ ID NO: 805969 - protein, 1122 aa, Homo sapiens; identical to SEQ ID NO: 805964

SEQ ID NO: 805970 - protein, 1122 aa, Homo sapiens; identical to SEQ ID NO: 805964

SEQ ID NO: 805971 - protein, 306 aa, Homo sapiens
QGLQRGDPPGRMHWLPAGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTDPRRHAVCRDRRHGGQPHKGMSAWWKDGIRPGTHPAHPTGVSQMPPAAHSGRTI

SEQ ID NO: 805972 - protein, 88 aa, Homo sapiens
PLSIARVQTPPWHPPGAPSPGTWLANSSRWGVGPKVQGPHGRSLPPGLLQDSDSLSGSYLDPNYQSIKWQPHQQNKWATLYDANYKEL

SEQ ID NO: 805973 - protein, 1583 aa, Homo sapiens
MKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKEKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 805974 - protein, 90 aa, Homo sapiens
ARPLTCSRAYVRGWRKQKCSGGGGWLRAGGGLAEMEDLVQDGVASPATPGTGKSKNWRKKLKNSDQNLLLKELVILLRVLLCRPGWSAMT

SEQ ID NO: 805975 - protein, 47 aa, Homo sapiens
MKKFEEDLLLLEDQNSELSEERELLGDRLAEFSSQAAEEEESASRPH

SEQ ID NO: 805976 - protein, 1718 aa, Homo sapiens
ARPLTCSRAYVRGWRKQKCSGGGGWLRAGGGLAEMEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKEKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 805977 - protein, 1596 aa, Homo sapiens
IKMKQEVDAIMPSLLKGKKDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKEKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 805978 - protein, 1703 aa, Homo sapiens
ARPLTCSRAYVRGWRKQKCSGGGGWLRAGGGLAEMEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKEKKQLQKTMQELELVKSERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 805979 - protein, 1696 aa, Homo sapiens
ARPLTCSRAYVRGWRKQKCSGGGGWLRAGGGLAEMEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKNCETINSDNEDLLARIETLQSNAKLLEVQILEVQRAKAMVDKELEAEKLQKEQKIKEHATTVNELEELQVQLQKEKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 805980 - protein, 1718 aa, Homo sapiens; identical to SEQ ID NO: 805976

SEQ ID NO: 805981 - protein, 1726 aa, Homo sapiens
ARPLTCSRAYVRGWRKQKCSGGGGWLRAGGGLAEMEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKEKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLPSTYRSPVD

SEQ ID NO: 805982 - protein, 525 aa, Homo sapiens
MEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 805983 - protein, 346 aa, Homo sapiens
MSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 805984 - protein, 999 aa, Homo sapiens
ARPLTCSRAYVRGWRKQKCSGGGGWLRAGGGLAEMEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIGNYGFADVVTIN

SEQ ID NO: 805985 - protein, 1008 aa, Homo sapiens
ARPLTCSRAYVRGWRKQKCSGGGGWLRAGGGLAEMEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIGKNRLERGKLLLQKKEGELLL

SEQ ID NO: 805986 - protein, 74 aa, Homo sapiens
TSEKHKIHEHLKTSAEQHQRTLSAYQQRVTALQEECRAAKVRSSGQPQQATGILLSASHWFTPGLCSAFLVFSC

SEQ ID NO: 805987 - protein, 113 aa, Homo sapiens
MCSRPTHLPGSCLPLDVLTPAPAAAAAAAAVAAAAAVAVLSRAGGTEQPPGQHSGAWPSADAHLVCQTATCFPTQPTKHSAHQDGLPRHPNPASYPLPVLEPQGPPFPCRHPV

SEQ ID NO: 805988 - protein, 228 aa, Homo sapiens
PREGNTSARYEAGWCSIKKKMTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 805989 - protein, 321 aa, Homo sapiens
GTRVHPGVEKDSKGQSTDRIMILVMKNRREEEDDEEEMEEKLAKAKGSQAPSLPNTSEAQKIKEVPTQFLDRDEEEEDADFLKVKRHNVFGLDLKDEKTLQKKEPSKSSIKKKMTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 805990 - protein, 228 aa, Homo sapiens; identical to SEQ ID NO: 805988

SEQ ID NO: 805991 - protein, 109 aa, Homo sapiens
MKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 805992 - protein, 107 aa, Homo sapiens
MSRSRPGCYFDAEAVWFTKCLNLAVNDNCQTHVEGKFLLIHKKEDSLPTLSGTNQSCMHYIIQISRNQIVKKFCWARWLIPVIPALWEAEAVGSPEVRSLRPAWPTG

SEQ ID NO: 805993 - protein, 118 aa, Homo sapiens
MPAPPKPGKPKKRKSLKLLGFLDVENTPCARHSILYGSLGSVVAGFGHFLFTSRIRRSCDVGVGGFILVTLGCWFHCRYNYAKQRIQERIAREEIKKKILYEGTHLDPERKHNGSSSN

SEQ ID NO: 805994 - protein, 74 aa, Homo sapiens
LRRQKQEAGRIRRSCDVGVGGFILVTLGCWFHCRYNYAKQRIQERIAREEIKKKILYEGTHLDPERKHNGSSSN

SEQ ID NO: 805995 - protein, 152 aa, Homo sapiens
MDEPQIFARPKSMICMYYMVPFIHEFLQLSYFKVVEIMLCRHSIIIPLKTRANILFLIIANAIRRLKNNGFYHFTNCYVDILFFLIKKECVDRYSDTKTAQKYHYKLEHIFQSQGSSHLYLSFVDLEKFHKLISVGLYINNLFIFFSSKVSL

SEQ ID NO: 805996 - protein, 118 aa, Homo sapiens
MAAPPEPGEPEERKSLKLLGFLDVENTPCARHSILYGSLGSVVAGFGHFLFTSRIRRSCDVGVGGFILVTLGCWFHCRYNYAKQRIQERIAREEIKKKILYEGTHLDPERKHNGSSSN

SEQ ID NO: 805997 - protein, 118 aa, Homo sapiens; identical to SEQ ID NO: 805996

SEQ ID NO: 805998 - protein, 71 aa, Homo sapiens
PLLSILQFSVLNCKGIQAQVVAYSSCFDRNCRDLCTESYYSLDDVTTGKLPTKPSSLGYFLMMWFGTMKMS

SEQ ID NO: 805999 - protein, 118 aa, Homo sapiens; identical to SEQ ID NO: 805996

SEQ ID NO: 806000 - protein, 70 aa, Homo sapiens
WYRPEIYGSGLSGSVTPPPRQESRSRFVFRTHLLPLSRPCRLCAELGRKCDPFDGTKDMTARPRAATAER

SEQ ID NO: 806001 - protein, 89 aa, Homo sapiens
SLLSIKSIGHQWYWTYEYTDYGGLIFNSYILPPLFLEPRRPVTRGNVHVDISTLSRGTYSSLNPQLQEKKWCIVIFAKAPQNEILSYSI

SEQ ID NO: 806002 - protein, 70 aa, Homo sapiens; identical to SEQ ID NO: 806000

SEQ ID NO: 806003 - protein, 117 aa, Homo sapiens
QASCTSLHLSYWKSLKLLGFLDVENTPCARHSILYGSLGSVVAGFGHFLFTSRIRRSCDVGVGGFILVTLGCWFHCRYNYAKQRIQERIAREEIKKKILYEGTHLDPERKHNGSSSN

SEQ ID NO: 806004 - protein, 70 aa, Homo sapiens; identical to SEQ ID NO: 806000

SEQ ID NO: 806005 - protein, 104 aa, Homo sapiens
HKTLLRISHLKQANMTNTLNSIHPPLPEEACPRGRSRKRRIRRSCDVGVGGFILVTLGCWFHCRYNYAKQRIQERIAREEIKKKILYEGTHLDPERKHNGSSSN

SEQ ID NO: 806006 - protein, 118 aa, Homo sapiens; identical to SEQ ID NO: 805996

SEQ ID NO: 806007 - protein, 70 aa, Homo sapiens; identical to SEQ ID NO: 806000

SEQ ID NO: 806008 - protein, 70 aa, Homo sapiens; identical to SEQ ID NO: 806000

SEQ ID NO: 806009 - protein, 118 aa, Homo sapiens; identical to SEQ ID NO: 805996

SEQ ID NO: 806010 - protein, 103 aa, Homo sapiens
MQSKESRKELPEKKLKRRYYMKVPTSILKENTTAAAAIEQYWQCNRHLSSEPLSEKKTLPLYSNLPTNLLSYNIHHVTWYYSYLISSSKTNNFNPPNALGGVN

SEQ ID NO: 806011 - protein, 152 aa, Homo sapiens [sequence omitted]

SEQ ID NO: 806012 - protein, 144 aa, Homo sapiens [sequence omitted]

SEQ ID NO: 806013 - protein, 144 aa, Homo sapiens [sequence omitted]

SEQ ID NO: 806014 - protein, 384 aa, Homo sapiens
MIGIVSQASRGLSSQITEFQNKRLEGRNADVLIESERARIKKLQEEKTRNLESSRKLEPTIVSEHKGGLRTEQTDIDVLGQHLTKEHVSSHSQSPIRDSQWFTLSPQEKLAWGTSSKDPRIAAGQQSPLEKKILNLGGVHTTAARQLIMQKYQEECEILCREQAVSLDYWLAKAESYYNKIIVEMMKEETGNEIYKKMEEKTTQSVEGLKQYCLVPEREMKHIERHIHQTGKAGEFKNKPFRQVLQPPNETKLPKIMPEGHGIQNAQRRKQVNEREQMQTKDHQERMIRGRELAEQRLKERILRRSQSQLLTYEKHERVKEIKEFERVIAYLLFQPCSRSRIKVSILMDKSQNGEKVNTIVKPYQRKFLAMPPFLRSQIGKIRD

SEQ ID NO: 806015 - protein, 167 aa, Homo sapiens [sequence omitted]

SEQ ID NO: 806016 - protein, 349 aa, Homo sapiens
MIGIVSQASRGLSSQITEFQNKRLEGRNADVLIESERARIKKLQEEKTRNLESSRKLEPTIVSEHKGGLRTEQTDIDVLGQHLTKEHVSSHSQSPIRDSQWFTLSPQEKLAWGTSSKDPRIAAGQQSPLEKKILNLGGVHTTAARQLIMQKYQEECEILCREQAVSLDYWLAKAESYYNKIIVEMMKEETGNEIYKKMEEKTTQSVEGLKQYCLVPEREMKHIERHIHQTGKAGEFKNKPFRQVLQPPNETKLPKIMPEGHGIQNAQRRKQVNEREQMQTKDHQERMIRGRELAEQRLKERILRRSQSQLLTYEKHERVKEIKEFERVIAYLLFQPCSRSRIKHVFQVL

SEQ ID NO: 806017 - protein, 144 aa, Homo sapiens [sequence omitted]

SEQ ID NO: 806018 - protein, 144 aa, Homo sapiens [sequence omitted]

SEQ ID NO: 806019 - protein, 592 aa, Homo sapiens
WGSIARVTLTVAAGRRSLQLAGRLGGPGAETMADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 806020 - protein, 330 aa, Homo sapiens
WGSIARVTLTVAAGRRSLQLAGRLGGPGAETMADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSECVALVAWSQI

SEQ ID NO: 806021 - protein, 335 aa, Homo sapiens
WGSIARVTLTVAAGRRSLQLAGRLGGPGAETMADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNTGQHLRRRVCCCLRRVC

SEQ ID NO: 806022 - protein, 292 aa, Homo sapiens
MQPWPAASPACILSPSLRRPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 806023 - protein, 292 aa, Homo sapiens; identical to SEQ ID NO: 806022

SEQ ID NO: 806024 - protein, 330 aa, Homo sapiens; identical to SEQ ID NO: 806020

SEQ ID NO: 806025 - protein, 330 aa, Homo sapiens; identical to SEQ ID NO: 806020

SEQ ID NO: 806026 - protein, 292 aa, Homo sapiens; identical to SEQ ID NO: 806022

SEQ ID NO: 806027 - protein, 292 aa, Homo sapiens; identical to SEQ ID NO: 806022

SEQ ID NO: 806028 - protein, 458 aa, Homo sapiens
MPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 806029 - protein, 553 aa, Homo sapiens
GNNKGTQSNTSAGRKPPGYVVCWERVYDSARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 806030 - protein, 330 aa, Homo sapiens; identical to SEQ ID NO: 806020

SEQ ID NO: 806031 - protein, 534 aa, Homo sapiens
WGSIARVTLTVAAGRRSLQLAGRLGGPGAETMADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCIFVMIWRYLLLMLAARL

SEQ ID NO: 806032 - protein, 589 aa, Homo sapiens
WGSIARVTLTVAAGRRSLQLAGRLGGPGAETMADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKIPNKKKKEKKCLDKYFQHLCDDLEVFAAHAGRKTVKPEDLELLMRRQGLVTDQVSLHVLVERHLPLEYRQLLIPCAYSGNSVFPAQ

SEQ ID NO: 806033 - protein, 330 aa, Homo sapiens; identical to SEQ ID NO: 806020

SEQ ID NO: 806034 - protein, 552 aa, Homo sapiens
WGSIARVTLTVAAGRRSLQLAGRLGGPGAETMADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRR

SEQ ID NO: 806035 - protein, 469 aa, Homo sapiens
WGSIARVTLTVAAGRRSLQLAGRLGGPGAETMADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLCQDAHGEEGS

SEQ ID NO: 806036 - protein, 180 aa, Homo sapiens
MELKRQRKRWKKKVSSPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 806037 - protein, 181 aa, Homo sapiens
MVRPGIPVTPPFFFVASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 806038 - protein, 261 aa, Homo sapiens
MPLAGQQVQSRPPAPLSLSRPGDIISFLSQPQRLVLQFYAKMPMERKALEIVEKCLDKYFQHLCDDLEVFAAHAGRKTVKPAGGQGCWSWLAKGHVVPSLSRSQQDLLLNKSLLEEVQPPLSTVALSLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 806039 - protein, 233 aa, Homo sapiens
MQLRSQTQTVWLRKYPESPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCIFVMIWRYLLLMLAARL

SEQ ID NO: 806040 - protein, 175 aa, Homo sapiens
WGSIARVTLTVAAGRRSLQLAGRLGGPGAETMADHNPDSDSTPRTLLRRVLDTADPRTPRRPRSARAGARRALLETASPRKLSGQTRTIARGRSHGARSVGRSAHIQASGHLEEQTPRTLLKNILLTAISQAVAILPPLPKIPTPSISPVAACAPLVVLPRYVGGSTRGDSLALH

SEQ ID NO: 806041 - protein, 481 aa, Homo sapiens
QPARGQPAAQRICRRGAKCTRRAARSCSPATAPRPAPPRGDSEPLPPPPGAERRALGWESGTRSRQLFISRKPPQPERKGTFCHQRGISQRRAWIYEDTHARSGQDLDKLFHRLRVRRSPRLVSFPLLSRRPPLPAMVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKVALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 806042 - protein, 557 aa, Homo sapiens
QPARGQPAAQRICRRGAKCTRRAARSCSPATAPRPAPPRGDSEPLPPPPGAERRALGWESGTRSRQLFISRKPPQPERKGTFCHQRGISQRRAWIYEDTHARSGQDLDKLFHRLRVRRSPRLVSFPLLSRRPPLPAMVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKVALLNDCVCDGLERPICESVKENMARLCFGAELGNGPGSSGSDGGLDDYYDEDYDDEQRTGGAGGEQPLDDDDGARTHRARAAALLHRAAAGTCPMGLGAGAAAAAAAWRPGAPGPHSPPSCCCCLGRSFSPRAPRAGHLWLGTDRRDGWGYFPKLFPSQLGVAGSPATTLGTSPEAPLRSLTSWTSSPAPIPSSRNSQLVCRPES

SEQ ID NO: 806043 - protein, 71 aa, Homo sapiens
SSRHGDSRPHNGSAGAEQNAPAAPRGPAAPPRPRGPHPPGATVSLSRHHRGPSGGLSGGRAGPDLDSCSFP

SEQ ID NO: 806044 - protein, 138 aa, Homo sapiens
MCGLFSAQCVTWHGLGVLGVCEMNVFKTQTLLCPSGVHSRPEDHDETPFLCSKAQSVTVVAFLVARLLATLATHQMTSHTEGLRKGGGRKDTQLMKGQCSAIKVIFWPGCLPQPRMHSRLHIRSINKGGQLRPTGCNK

SEQ ID NO: 806045 - protein, 86 aa, Homo sapiens
DWVIAPQGYSAYYCEGECSFPLDSCMNATNHAILQSLVHLMKPNAVPKACCAPTKLSATSVLYYDSSNNVILRKHRNMVVKACGCH

SEQ ID NO: 806046 - protein, 110 aa, Homo sapiens
GAERGPERSSSAGRGAKSGRQGSQAGERSGSGGQGLVTKAAGDGPRGTKLAAQLPRRGHLLRVPGPNRYQISGARKWTGAVQGEMVDGHKNPKYNVQNEEQLIKFWASLE

SEQ ID NO: 806047 - protein, 88 aa, Homo sapiens
ASTQPRASLFSHKKVAVRGWSRLAGATYRGVYGTSLLRHAKVVWEMLKFEVALRLETLAMRLTALLARALVHLSLVPPAEELYQYLET

SEQ ID NO: 806048 - protein, 257 aa, Homo sapiens
GGLVLCPLQCLSSPQIAEKLIKAFAEQIFYTGFIHSDPHPGNVLVRKGPDGKAELVLLDHGLYQFLEEKDRAALCQLWRAIILRDDAAMRAHAAALGVQDYLLFAEMLMQRPVRLGQLWGSHLLSREEAAYMVDMARERFEAVMAVLRELPRPMLLVLRNINTVRAINVALGAPVDRYFLMAKRAVRGWSRLAGATYRGVYGTSLLRHAKVVWEMLKFEVALRLETLAMRLTALLARALVHLSLVPPAEELYQYLET

SEQ ID NO: 806049 - protein, 250 aa, Homo sapiens
EPGVAVHDIAEKLIKAFAEQIFYTGFIHSDPHPGNVLVRKGPDGKAELVLLDHGLYQFLEEKDRAALCQLWRAIILRDDAAMRAHAAALGVQDYLLFAEMLMQRPVRLGQLWGSHLLSREEAAYMVDMARERFEAVMAVLRELPRPMLLVLRNINTVRAINVALGAPVDRYFLMAKRAVRGWSRLAGATYRGVYGTSLLRHAKVVWEMLKFEVALRLETLAMRLTALLARALVHLSLVPPAEELYQYLET

SEQ ID NO: 806050 - protein, 93 aa, Homo sapiens
TAWRYFEERLLDAETLLVVLDVGEQVAAVGAGRDVVGVLDGRARDHVVHSEECLVANLVLAEPQSRLPVALRGPSSSACGQAGQRRPETPRWT

SEQ ID NO: 806051 - protein, 157 aa, Homo sapiens
DEKETGHTLGSQPRPCPRDTLALGHSHGSRQGQLDQEVKGDWRPTDRWGFGLKLQVNPQFRNSGTGTRALLTWQHRQGAGGRAHASLRHAGREPVATPNTPLLLTPGLRPTLHGSAQKAARTTHTEAGISLTTRVCRGGAVDGPAPSVPIFLPKHIL

SEQ ID NO: 806052 - protein, 329 aa, Homo sapiens
IRHEPAAADLLGPGPSPSPAPASPDGAMRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDESPSRRQTWTRSEEEEGECPAHEEARRTMRSSAGQAWKWAPVHRPQDESDKGEFGKRAKSRDMLG

SEQ ID NO: 806053 - protein, 765 aa, Homo sapiens
IRHEPAAADLLGPGPSPSPAPASPDGAMRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDGKTLPSWGQALLSQDFELLCRDGSRADVTEWRQCHLARVPAHAVVVRADTDGGLIFRLLNEGQRLFSHEGSSFQMFSSEAYGQKDLLFKDSTSELVPIATQTYEAWLGHEYLHAMKGLLCDPNRLPPYLRWCVLSTPEIQKCGDMAVAFRRQRLKPEIQCVSAKSPQHCMERIQAEQVDAVTLSGEDIYTAGKKYGLVPAAGEHYAPEDSSNSYYVVAVVRRDSSHAFTLDELRGKRSCHAGFGSPAGWDVPVGALIQRGFIRPKDCDVLTAVSEFFNASCVPVNNPKNYPSSLCALCVGDEQGRNKCVGNSQERYYGYRGAFRCLVENAGDVAFVRHTTVFDNTNGHNSEPWAAELRSEDYELLCPNGARAEVSQFAACNLAQIPPHAVMVRPDTNIFTVYGLLDKAQDLFGDDHNKNGFKMFDSSNYHGQDLLFKDATVRAVPVGEKTTYRGWLGLDYVAALEGMSSQQCSGAAAPAPGAPLLPLLLPALAARLLPPAL

SEQ ID NO: 806054 - protein, 516 aa, Homo sapiens
IRHEPAAADLLGPGPSPSPAPASPDGAMRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDGKTLPSWGQALLSQDFELLCRDGSRADVTEWRQCHLARVPAHAVVVRADTDGGLIFRLLNEGQRLFSHEGSSFQMFSSEAYGQKDLLFKDSTSELVPIATQTYEAWLGHEYLHAMKGLLCDPNRLPPYLRWCVLSTPEIQKCGDMAVAFRRQRLKPEIQCVSAKSPQHCMERIQVGVTQVQRGPGGRVVAVPGQFLLPTPPAAWGRGECLLQQAHRDGWGGATAGASTHPRGQRQAGRSDRRGQHPPQGTGR

SEQ ID NO: 806055 - protein, 437 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKDTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 806056 - protein, 413 aa, Homo sapiens
MWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 806057 - protein, 955 aa, Homo sapiens
LEEPVQEDATQETHISSPVESPSQKTKSETVTGELSKLLDEIKLCQEKDYSFEDLCHTISDHYLDNLSKISEEELGKNGSQSVRTSSTINLSPGEVEEEDDDENTCGPSGLWEALTPCNGCRNLGFPMLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGETTRPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 806058 - protein, 331 aa, Homo sapiens
AEGGARAGLGSSRGEPGARRSAARPSSAPLPPFLGALALASPLAFAGGAQKDAQRQRLGERRFKPHVCVLGGQSPPALADPGSRPARAARVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNHIGGPETSGIFLGGQSQKN

SEQ ID NO: 806059 - protein, 219 aa, Homo sapiens
MWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRVSAKHIHLVLCPYLKNYLFETSLANMVRPCLY

SEQ ID NO: 806060 - protein, 482 aa, Homo sapiens
AEGGARAGLGSSRGEPGARRSAARPSSAPLPPFLGALALASPLAFAGGAQKDAQRQRLGERRFKPHVCVLGGQSPPALADPGSRPARAARVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806061 - protein, 482 aa, Homo sapiens; identical to SEQ ID NO: 806060

SEQ ID NO: 806062 - protein, 543 aa, Homo sapiens
MWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806063 - protein, 507 aa, Homo sapiens
AEGGARAGLGSSRGEPGARRSAARPSSAPLPPFLGALALASPLAFAGGAQKDAQRQRLGERRFKPHVCVLGGQSPPALADPGSRPARAARVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806064 - protein, 422 aa, Homo sapiens
AEGGARAGLGSSRGEPGARRSAARPSSAPLPPFLGALALASPLAFAGGAQKDAQRQRLGERRFKPHVCVLGGQSPPALADPGSRPARAARVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806065 - protein, 487 aa, Homo sapiens
MANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806066 - protein, 416 aa, Homo sapiens
MANGFDNVQFMGSNVMEDQDLLEIGILNSGHRQRILQAIQLLPKMRPIGHDGYHPTSVAEWLDSIELGDYTKAFLINGYTSMDLLKKIWEVELINQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806067 - protein, 472 aa, Homo sapiens
MEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806068 - protein, 472 aa, Homo sapiens
AEGGARAGLGSSRGEPGARRSAARPSSAPLPPFLGALALASPLAFAGGAQKDAQRQRLGERRFKPHVCVLGGQSPPALADPGSRPARAARVLKINLIGHRKRILASLGDRLHDDPPQKPPRSITLRLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806069 - protein, 231 aa, Homo sapiens
MRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806070 - protein, 324 aa, Homo sapiens
MQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVRSTHLSKRLWPIYRGLWSRAKKPRGALIPSMKPRFSDTRRPPVLAVPCSPSGPGAGFPSRLRVHPAQEEDCSERAALLRAKGHWPFLGKFFLHQ

SEQ ID NO: 806071 - protein, 482 aa, Homo sapiens; identical to SEQ ID NO: 806060

SEQ ID NO: 806072 - protein, 482 aa, Homo sapiens; identical to SEQ ID NO: 806060

SEQ ID NO: 806073 - protein, 341 aa, Homo sapiens
AEGGARAGLGSSRGEPGARRSAARPSSAPLPPFLGALALASPLAFAGGAQKDAQRQRLGERRFKPHVCVLGGQSPPALADPGSRPARAARVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVVSTHPLSTD

SEQ ID NO: 806074 - protein, 362 aa, Homo sapiens
AEGGARAGLGSSRGEPGARRSAARPSSAPLPPFLGALALASPLAFAGGAQKDAQRQRLGERRFKPHVCVLGGQSPPALADPGSRPARAARVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVKLARIFAQASWVDSVPLSSFISIEPLQGTH

SEQ ID NO: 806075 - protein, 353 aa, Homo sapiens
AEGGARAGLGSSRGEPGARRSAARPSSAPLPPFLGALALASPLAFAGGAQKDAQRQRLGERRFKPHVCVLGGQSPPALADPGSRPARAARVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEGPGMPEGPGMPEGPGMPEGPGMPEGPGMPEGPGMQKVQVCQKSRMPVR

SEQ ID NO: 806076 - protein, 211 aa, Homo sapiens
LCAHLFGLSDCPVLSGSGAVYRVCAGTATFHLLQAVLLVHLHSPTSPRAQLHNSMALHWHLWRLCIHPTAVGAYYSFCPFLEQELSNPALASYKLLSSAAIIMYLTFSALSSRPPERVILQGQNHTLCLPGLSKMEPQTPDISLAMLSASIMYACVLFACNEASYLAEVFGPLWIVKVYSYEFQKPSLCFCCPETVEADKGEAKGWGCEAS

SEQ ID NO: 806077 - protein, 136 aa, Homo sapiens
CVPTCLASLTVQCSVALGLCTEYVQEPPPSTCCRLCCWSTSTPPPARGHSCIIAWHYIGICGGFAFILLQLVLITAFAHSWNKNCNEASYLAEVFGPLWIVKVYSYEFQKPSLCFCCPETVEADKGEAKGWGCEAS

SEQ ID NO: 806078 - protein, 100 aa, Homo sapiens
GQRQAQGVILSLGLLSLEDGWSKMEPQTPDISLAMLSASIMYACVLFACNEASYLAEVFGPLWIVKVYSYEFQKPSLCFCCPETVEADKGEAKGWGCEAS

SEQ ID NO: 806079 - protein, 70 aa, Homo sapiens
QFDIFPLVPILQHGITLASVEALHSSYCSWCLLQLLPIPGTRTGKGHITLKAFPGEFLVLLHGKGWAKGT

SEQ ID NO: 806080 - protein, 178 aa, Homo sapiens
LKYSFFTYGLFSENKEKLINNAITALLSQEGDVVASNAELESQFQAVRRLVASKAGFLAFTQLPKFRERLGVKVVKALKRSNNGIIHAAVDMLCALMCPMHDDYDLRQEQLNKASLLSSKKFLENLLEKFNSHVDHGTGALVISSLLDFLTFALCAPYSETTEGQQFDMLLEMVASNG

SEQ ID NO: 806081 - protein, 207 aa, Homo sapiens
MNVARFLVEKHTLHVIIDFILSKVSNQQSNLAQHQRVYTGEKPYKCNEWGKALSGKSSLFYHQAIHGVGKLCKCNDCHKVFSNATTIANHWRIHNEDRSYKCNKCGKIFRHRSYLAVYQRTHTGEKPYKYHDCGKVFSQASSYAKHRRIHTGEKPHKCDDCGKVLTSRSHLIRHQRIHTGQKSYKCLKCGKVFSLWALHAEHQKIHF

SEQ ID NO: 806082 - protein, 465 aa, Homo sapiens
MALPQGLLTFRDVAIEFSQEEWKCLDPAQRTLYRDVMLENYRNLVSLDTSSKCMMKMFSSTGQGNTEVVHTGTLQIHASHHIGDTCFQEIEKDIHDFVFQWQENETNGHEALMTKIKKLMSSTERHDQRHAGNKPIKNELGSSFHSHLPEVHIFHPEGKIGNQVEKAINDAFSVSASQRISCRPKTRISNKYRNNFLQSSLLTQKREVHTREKSFQRNESGKAFNGSSLLKKHQIIHLGDKQYKCDVCGKDFHQKRYLACHRCHTGENPYKCNECGKTFSHNSALLVHKAIHTGEKPYKCNECGKVFNQQSNLARHHRVHTGEKPYKCEECDKVFSRKSHLERHRRIHTGEKPYKCKVCDKAFRRDSHLAQHTVIHTGEKPYKCNECGKTFVQNSSLVMHKVIHTGEKRYKCNECGKVFNHKSNLACHHRLHTGEKPYKCNECGKVFNRKSNLERHHRLHTGKKS

SEQ ID NO: 806083 - protein, 173 aa, Homo sapiens [sequence omitted]

SEQ ID NO: 806084 - protein, 173 aa, Homo sapiens [sequence omitted]

SEQ ID NO: 806085 - protein, 173 aa, Homo sapiens [sequence omitted]

SEQ ID NO: 806086 - protein, 107 aa, Homo sapiens
SVALPFGINELCGACAASERPAGGAWRLPANPPFSSRARGQSQSHHREHPGQKNGSYTQSLPPSYHSCRFPSSFLHASTLPHRKRRPFLLQFLPAVPQRLSSLARRE

SEQ ID NO: 806087 - protein, 219 aa, Homo sapiens
QQDVAQFADFREVLTTRATQLSEELAQLRDAYQKQKEQLRQQLEAPPSQRDGHFLQESRRLSAQFENLMAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKAMLLPKSLEQADAPTSQAGGMETQSQGAV

SEQ ID NO: 806088 - protein, 213 aa, Homo sapiens
QQDVAQFADFREVLTTRATQLSEELAQLRDAYQKQKEQLRQQLEAPPSQRDGHFLQESRRLSAQFENLMAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKGCLEIYGQICNPETAKNFLAKDH

SEQ ID NO: 806089 - protein, 102 aa, Homo sapiens
MSNTTVPNAPQANSDSMVGYVLGPFFLITLVGVVVAVVMYVQKKKRVDRLRHHLLPMYSYDPAEELHEAEQELLSDMGDPKVVHGWQSGYQHKRMPLLDVKT

SEQ ID NO: 806090 - protein, 102 aa, Homo sapiens; identical to SEQ ID NO: 806089

SEQ ID NO: 806091 - protein, 102 aa, Homo sapiens; identical to SEQ ID NO: 806089

SEQ ID NO: 806092 - protein, 102 aa, Homo sapiens; identical to SEQ ID NO: 806089

SEQ ID NO: 806093 - protein, 159 aa, Homo sapiens
MYRRKSGWTGCAITCSPCTAMTQLRNCMRLSRSCSLTWETPRWYMAGRVATSTSGCHCWMSRRDLTPLPHPSEPGVLDCLGPCHLLPLLSPGSPCWVLGLHFSLHPPSAASASHALTITSLPPGLLPFVGVELTAHPQALMGRGFPSGMAAAGRHLCFL

SEQ ID NO: 806094 - protein, 139 aa, Homo sapiens
MTQLRNCMRLSRSCSLTWETPRWYMAGRVATSTSGCHCWMSRRDLTPLPHPSEPGVLDCLGPCHLLPLLSPGSPCWVLGLHFSLHPPSAASASHALTITSLPPGLLPFVGVELTAHPQALMGRGFPSGMAAAGRHLCFL

SEQ ID NO: 806095 - protein, 139 aa, Homo sapiens; identical to SEQ ID NO: 806094

SEQ ID NO: 806096 - protein, 102 aa, Homo sapiens; identical to SEQ ID NO: 806089

SEQ ID NO: 806097 - protein, 167 aa, Homo sapiens [sequence omitted]

SEQ ID NO: 806098 - protein, 167 aa, Homo sapiens [sequence omitted]

SEQ ID NO: 806099 - protein, 102 aa, Homo sapiens; identical to SEQ ID NO: 806089

SEQ ID NO: 806100 - protein, 161 aa, Homo sapiens
GRPGVGAIAALPCPPGSLGASAPLFVETSFHRRRVTPAAVQRPRDVQSQAHGAQARRAAWNGPRQAVTGTSPEGRGRCPPGQELARQALPRAASLLDYGIATELYKDTIWGRTAGEDWRGGTRLACCLSSSGGQGQESRVTVSRDGQCVPKERNREKGNQA

SEQ ID NO: 806101 - protein, 338 aa, Homo sapiens
MEQLRAAARLQIVLGHLGRPSAGAVVAHPTSGTISSASFHPQQFQYTLDNNVLTLEQRKFYEENGFLVIKNLVPDADIQRFRNEFEKICRKEVKPLGLTVMRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 806102 - protein, 66 aa, Homo sapiens
PELLRDPGSFCWSETLGRAESRRKPEGLPSGSLGAAVLLPACANRKGLVMLAAGLPPGLRHCHQIL

SEQ ID NO: 806103 - protein, 338 aa, Homo sapiens; identical to SEQ ID NO: 806101

SEQ ID NO: 806104 - protein, 238 aa, Homo sapiens
MRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 806105 - protein, 238 aa, Homo sapiens; identical to SEQ ID NO: 806104

SEQ ID NO: 806106 - protein, 238 aa, Homo sapiens; identical to SEQ ID NO: 806104

SEQ ID NO: 806107 - protein, 246 aa, Homo sapiens
MPIFNAFVMRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 806108 - protein, 238 aa, Homo sapiens; identical to SEQ ID NO: 806104

SEQ ID NO: 806109 - protein, 338 aa, Homo sapiens; identical to SEQ ID NO: 806101

SEQ ID NO: 806110 - protein, 102 aa, Homo sapiens
RPPWGRGNCRVALPSGIPGGLCSSLCGDVVSPAARDPGSCPETQRCPITGARCTGAQGCLERAQAGSDRDLSGGERTVPSRAGAGQAGAAQGGLPAGLRHCH

SEQ ID NO: 806111 - protein, 119 aa, Homo sapiens
MPPPTGTARQPCLETQRHRVTFALHTWLSLDVGLCATARNTKEDTHANTIKSLLFYFNIQEQCTLSVQPSSQHVLCGCGHVWIAEPTSAQRRRVLLLKNLEVCVWSFVLCNSLIIEAIY

SEQ ID NO: 806112 - protein, 259 aa, Homo sapiens
RQFLPLPVPPGSSSGHGTGNYQPVGLRALHSLAMDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGSRYCRSRGISLRASYLPESVTNSILRPLKESSPW

SEQ ID NO: 806113 - protein, 174 aa, Homo sapiens
MDRDLLRQSLNCHGSSLLSLLRSEQQDNPHFRSLLGSAAEPARGPPPQHPLQGRKEKRVDNIEIQKFISNEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRGD

SEQ ID NO: 806114 - protein, 472 aa, Homo sapiens
RQFLPLPVPPGSSSGHGTGNYQPVGLRALHSLAMDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQVIPYFLLEI

SEQ ID NO: 806115 - protein, 472 aa, Homo sapiens; identical to SEQ ID NO: 806114

SEQ ID NO: 806116 - protein, 339 aa, Homo sapiens
MPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQVIPYFLLEI

SEQ ID NO: 806117 - protein, 454 aa, Homo sapiens
RQFLPLPVPPGSSSGHGTGNYQPVGLRALHSLAMDRDLLRQSLNCHGSSLLSLLRSEQQDNPHFRSLLGSAAEPARGPPPQHPLQGRKEKRVDNIEIQKFISNEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQVIPYFLLEI

SEQ ID NO: 806118 - protein, 224 aa, Homo sapiens
EFHRNANGYAVRIHKNREVRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQVIPYFLLEI

SEQ ID NO: 806119 - protein, 246 aa, Homo sapiens
METYHISNARVSGRKFFHEEVYELVVAERGYAVRIQKYREVRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQVIPYFLLEI

SEQ ID NO: 806120 - protein, 472 aa, Homo sapiens; identical to SEQ ID NO: 806114

SEQ ID NO: 806121 - protein, 472 aa, Homo sapiens; identical to SEQ ID NO: 806114

SEQ ID NO: 806122 - protein, 500 aa, Homo sapiens
RQFLPLPVPPGSSSGHGTGNYQPVGLRALHSLAMDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKR

SEQ ID NO: 806123 - protein, 472 aa, Homo sapiens; identical to SEQ ID NO: 806114

SEQ ID NO: 806124 - protein, 472 aa, Homo sapiens; identical to SEQ ID NO: 806114

SEQ ID NO: 806125 - protein, 472 aa, Homo sapiens; identical to SEQ ID NO: 806114

SEQ ID NO: 806126 - protein, 803 aa, Homo sapiens
RQFLPLPVPPGSSSGHGTGNYQPVGLRALHSLAMDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKRLKKKRRKSTSSSSVSSADESVSSSSSSSSSGHKRHKKHKRNRSESSRSSRRHSSRASSNQIDQNRKDECYPVPANTSASFLNHKQEVEKLLGKQDRLQYEKTQIKEKDRCPLSSSSLEIPDDFGGRSEDPRDFYNSYKTQAGSSKTEKPYKSERHFSSRRNSSDSFCRNSEDKIYGYRRFEKDIEGRKEHYRRWEPGSVRHSTSPASSEYSWKSVEKYKKYAHSGSRDFSRHEQRYRLNTNQGEYEREDNYGEDIKTEVPEEDALSSKEHSESSVKKNLPQNLLNIFNQIAEFEKEKGNKSKN

SEQ ID NO: 806127 - protein, 472 aa, Homo sapiens; identical to SEQ ID NO: 806114

SEQ ID NO: 806128 - protein, 472 aa, Homo sapiens; identical to SEQ ID NO: 806114

SEQ ID NO: 806129 - protein, 472 aa, Homo sapiens; identical to SEQ ID NO: 806114

SEQ ID NO: 806130 - protein, 472 aa, Homo sapiens; identical to SEQ ID NO: 806114

SEQ ID NO: 806131 - protein, 253 aa, Homo sapiens
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 806132 - protein, 253 aa, Homo sapiens; identical to SEQ ID NO: 806131

SEQ ID NO: 806133 - protein, 253 aa, Homo sapiens; identical to SEQ ID NO: 806131

SEQ ID NO: 806134 - protein, 253 aa, Homo sapiens; identical to SEQ ID NO: 806131

SEQ ID NO: 806135 - protein, 253 aa, Homo sapiens; identical to SEQ ID NO: 806131

SEQ ID NO: 806136 - protein, 206 aa, Homo sapiens
MGVWQEIKYLSNLIPDAFHTRIKSLMTAKFQAYLWLPNETGPTRMGTGEGTHMSAQASVYTSPLQPEVRLGAHPGAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 806137 - protein, 105 aa, Homo sapiens [sequence omitted]

SEQ ID NO: 806138 - protein, 259 aa, Homo sapiens
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATLTCGLLHIHPGSPCQQRSLYPQHHPLPSQCTQ

SEQ ID NO: 806139 - protein, 210 aa, Homo sapiens
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVTTGGMVLKLEQGENVFLQATDKNSLLGMEGANSIFSGFLLFPDMEA

SEQ ID NO: 806140 - protein, 109 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMVGSACSKFCYKSFVAYSKI

SEQ ID NO: 806141 - protein, 1005 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEKNIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLDRKRSASAPTLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 806142 - protein, 1005 aa, Homo sapiens; identical to SEQ ID NO: 806141

SEQ ID NO: 806143 - protein, 1005 aa, Homo sapiens; identical to SEQ ID NO: 806141

SEQ ID NO: 806144 - protein, 1005 aa, Homo sapiens; identical to SEQ ID NO: 806141

SEQ ID NO: 806145 - protein, 1014 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 806146 - protein, 998 aa, Homo sapiens
MVSSTGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 806147 - protein, 983 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 806148 - protein, 780 aa, Homo sapiens
MAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 806149 - protein, 984 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGDRAPAESRPFGTLPPRPPGQDTSMDDNPFGTRKVRSSFGRGFFKIKSNKRTASAPNLDRKRSASAPTLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 806150 - protein, 170 aa, Homo sapiens [sequence omitted]

SEQ ID NO: 806151 - protein, 886 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNPVNLW

SEQ ID NO: 806152 - protein, 845 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVNTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNPVNLW

SEQ ID NO: 806153 - protein, 170 aa, Homo sapiens [sequence omitted]

SEQ ID NO: 806154 - protein, 283 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRGKKIYFTFIISFC

SEQ ID NO: 806155 - protein, 261 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKVSFSHRLTFSNKWHHYSSMPNNINKMFST

SEQ ID NO: 806156 - protein, 85 aa, Homo sapiens
RRRRRLKRQIPVPPTRERRLRQRGEWAGGSHKLQGKEKPSTGITFIPDAPNIISLQGKRVFIALRLKMYSRFSPFSLLLCIFWMW

SEQ ID NO: 806157 - protein, 149 aa, Homo sapiens
IQVVKTGRGLQPRVHLPTEQVVNSPGERNCQLPLSVSPEGPRTPPPPCLLRSREEEPEVGAPSAAARAPPTEPAAGTPNPRLEPAAPGLSHRNASPRGATGAWRLTAAFGSRSAHTLSGFRLSPEARLRLACGSIRCGQARSYTQEKWS

SEQ ID NO: 806158 - protein, 164 aa, Homo sapiens
MAKEWGYASHNGPDHWHELFPNAKGENQSPIELHTKDIRHDPSLQPWSVSYDGGSAKTILNNGKTCRVVFDDTYDRSMLRGGPLPGPYRLRQFHLHWGSSDDHGSEHTVDGVKYAAEVRGTAIIHSRSHTVKTAKLKIRTTATKHHPLLLFQVYSYEKSCTSFS

SEQ ID NO: 806159 - protein, 260 aa, Homo sapiens [sequence omitted]

SEQ ID NO: 806160 - protein, 260 aa, Homo sapiens [sequence omitted]

SEQ ID NO: 806161 - protein, 225 aa, Homo sapiens
MHGGRREDEVRAACISARRRRLETLQFGERRRGDGGARSHDSRESAGRGVGAPSPTSAPVTSTAVPLLEFIGFLYPASQTPPQSSLAPRPTLADLIRPCSVRGSYIKARARGDSAPRRGRESRSRPARRKATMAKEWGYASHNGPDHWHELFPNAKGENQSPIELHTKDIRHDPSLQPWSVSYDGGSAKTILNNGKTCRVVFDDTYDRSMLRGGPLPGPYRTAYQ

SEQ ID NO: 806162 - protein, 183 aa, Homo sapiens
FGIKLETNMLPIGTLCPKIYLCFSKIKISRMVLNEDGYSSTIKDKILTIDVKPGWRQGTRITFEKEGDQGPNIIPADIIFIVKEKLHPRFRRENDNLFFVNPIPLGKALTCCTVEVRTLDDRLLNIPINDIIHPKYFKKVPGEGMPLPEDPTKKGDLFIFFDIQFPTRLTPQKKQMLRQALLT

SEQ ID NO: 806163 - protein, 720 aa, Homo sapiens
WGAGVGWGRMLDGPLFSEGPDSPRELQDEESGSCLWVQKSKLLVIEVKTISCHYSRRAPSRQPMDFQASHWARGFQNRTCGPRPGSPQPPPRRPWASRVLQEATNWRAGPLAEVRAREQEKRKAASQEREAKETERKRRKAGGARRSPPGRPRPEPRNAPRVAQLAGLPAPLRPERLAPVGRAPRPSAQPQSDPGSAWAGPWGGRRPGPPSYEAHLLLRGSAGTAPRRRWDRPPPYVAPPSYEGPHRTLGTKRGPGNSQVPTSSAPAATPARTDGGRTKKRLDPRIYRDVLGAWGLRQGQGLLGGSPGCGAARARPEPGKGVVEKSLGLAAADLNSGSDSHPQAKATGSAGTEIAPAGSATAAPCAPHPAPRSRHHLKGSREGKEGEQIWFPKCWIPSPKKQPPRHSQTLPRPWAPGGTGWRESLGLGEGAGPETLEGWKATRRAHTLPRSSQGLSRGEGVFVIDATCVVIRSQYVPTPRTQQVQLLPSGVTRVVGDSPSQSKPGKEEGEGATVFPSPCQKRLSSSRLLHQPGGGRGGEAEGGRPGDSTLEERTFRILGLPAPEVNLRDAPTQPGSPEHQALGPAASGAQGRAEGSEVAVVQRRAGRGWARTPGPYAGALREAVSRIRRHTAPDSDTDEAEELSVHSGSSDGSDTEAPGASWRNERTLPEVGNSSPEEDGKTAELSDSVGEILDVISQTEEVLFGVRDIRGTQQGNRKRQ

SEQ ID NO: 806164 - protein, 720 aa, Homo sapiens; identical to SEQ ID NO: 806163

SEQ ID NO: 806165 - protein, 741 aa, Homo sapiens
WGAGVGWGRMLDGPLFSEGPDSPRELQDEESGSCLWVQKSKLLVIEVKTISCHYSRRAPSRQPMDFQASHWARGFQNRTCGPRPGSPQPPPRRPWASRVLQEATNWRAGPLAEVRAREQEKRKAASQEREAKETERKRRKAGGARRSPPGRPRPEPRNAPRVAQLAGLPAPLRPERLAPVGRAPRPSAQPQSDPGSAWAGPWGGRRPGPPSYEAHLLLRGSAGTAPRRRWDRPPPYVAPPSYEGPHRTLGTKRGPGNSQVPTSSAPAATPARTDGGRTKKRLDPRIYRDVLGAWGLRQGQGLLGGSPGCGAARARPEPGKGVVEKSLGLAAADLNSGSDSHPQAKATGSAGTEIAPAGSATAAPCAPHPAPRSRHHLKGSREGKEGEQIWFPKCWIPSPKKQPPRHSQTLPRPWAPGGTGWRESLGLGEGAGPETLEGWKATRRAHTLPRSSQGLSRGEGVFVIDATCVVIRSQYVPTPRTQQVQLLPSGVTRVVGDSPSQSKPGKEEGEGATVFPSPCQKRLSSSRLLHQPGGGRGGEAEGGRPGDSTLEERTFRILGLPAPEVNLRDAPTQPGSPEHQALGPAASGAQGRAEGSEVAVVQRRAGRGWARTPGPYAGALREAVSRIRRHTAPDSDTDEAEELSVHSGSSDGSDTEAPGASWRNERTLPEVGNSSPEEDGKTAELSDSVGEILDVIRDSGTERQCRGDPRCSHGLSFPLKASVEQSPFTPARRGPRGEAEG

SEQ ID NO: 806166 - protein, 115 aa, Homo sapiens
MNRSLSQRELRGNALQKRCWYQKSAVFSVISRAEGLPAPHTVSVTGAACSPDPFRKELPPLSAATDTAPSRAAPCPSTPGAAGRANNKEPPLPLLADLTLQVVLFWDLQQQKTPS

SEQ ID NO: 806167 - protein, 666 aa, Homo sapiens
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAEACQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 806168 - protein, 666 aa, Homo sapiens; identical to SEQ ID NO: 806167

SEQ ID NO: 806169 - protein, 479 aa, Homo sapiens
MKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 806170 - protein, 479 aa, Homo sapiens; identical to SEQ ID NO: 806169

SEQ ID NO: 806171 - protein, 666 aa, Homo sapiens; identical to SEQ ID NO: 806167

SEQ ID NO: 806172 - protein, 666 aa, Homo sapiens; identical to SEQ ID NO: 806167

SEQ ID NO: 806173 - protein, 479 aa, Homo sapiens; identical to SEQ ID NO: 806169

SEQ ID NO: 806174 - protein, 126 aa, Homo sapiens
MLRSVSNDCNFCIVSFNEKGQLWCEESLSLLLNSSTKQGFPTSGIRTCTNPWPVRKWATQQKLSRNTSLKTKCLQDPQYCSSSPEGLVLAFLPEKVEKQHKCLFTLQIVVFYKTTIQMQLFRILSR

SEQ ID NO: 806175 - protein, 524 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 806176 - protein, 553 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGDPSIFCSLPLGFFIVSSMVMLIGARYISGIP

SEQ ID NO: 806177 - protein, 118 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVDCLTNE

SEQ ID NO: 806178 - protein, 530 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKISHSVKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 806179 - protein, 465 aa, Homo sapiens
RSARVAKFRCCLIPDSDSITCIPLKPAFSGMAPDVAYSTPTSGGQQAQATHCQVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 806180 - protein, 499 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEGTFKE

SEQ ID NO: 806181 - protein, 420 aa, Homo sapiens
LNPHEAESLALVGAMIDQVLELHPGAQRLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGMSGLATPSPTGPSPKDPEGRRPSTQCSNHPAGLWWSSQSEDGLTAPAQPPTCPEVHPGWACVWVSRPKPKAGWRVTREAPLRHSESAEMHAGRRWGTAPPLLHTRPAHLAEQVWGSGARPWKAPHPGPSTHTSRSPEGAAGPMGRGRHRGTLGVGRGLGQRSCVCGNSQATREISDCVVLMQKEKWPRRAERYPAGAAAQGRGRGR

SEQ ID NO: 806182 - protein, 372 aa, Homo sapiens
LNPHEAESLALVGAMIDQVLELHPGAQRLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGGFDEDVKAKVENLLGISSLEKTDPVREGAGSFPGSNILALVTQVSLHLRSSVDALLEGNRYVTGWFSPYHRQRKLIHPVMVQHIQPAALSLLAQWSTLVQELEAALQLAFYPDAVEEWLEENVHPSLQRLQALLQDLSEVSAPPLPPTSPGRDVAQDP

SEQ ID NO: 806183 - protein, 578 aa, Homo sapiens
LNPHEAESLALVGAMIDQVLELHPGAQRLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGMSGLATPSPTGPSPKDPEGRRPSTQCSNHPAGLWWSSQSEDGLTAPAQPPTCPEVHPGWACVWVSRPKPKAGWRVTREAPLRHSESAEMHAGRRWGTAPPLLHTRPAHLAEQVWGSGARPWKAPHPGPSTHTSRSPEGAAGPMGRGRHRGTLGVGRGLGQRSCVCGNSQATREISDCVVLMQKEKWPRRAERYPEARRPRDGDAAGGFDEDVKAKVENLLGISSLEKTDPVREGAGSFPGSNILALVTQVSLHLRSSVDALLEGNRYVTGWFSPYHRQRKLIHPVMVQHIQPAALSLLAQWSTLVQELEAALQLAFYPDAVEEWLEENVHPSLQRLQALLQDLSEVSAPPLPPTSPGRDVAQDP

SEQ ID NO: 806184 - protein, 248 aa, Homo sapiens
GEGGWAGGAAAWAPGGWQHAWARRGLPSPSPSRPQESGSPTAERRGKGGGRELEEKKGSAESLTLLSAGSWAGWVARGGEKGRGRGWGKGGALARCSFRAAPAAATAGASFPIHSNKQDGCRYAAALPAAQILGSNRQDVYGQNGTCAPAPAQAPPSPQKERPGAMTISFSLEPALCLWSPQLSKRKEIFPVMKEIEEDTQKWKYIPCSWIGRINIVKISILPRAIYRFNVIPIKISMTFFTERGKKS

SEQ ID NO: 806185 - protein, 704 aa, Homo sapiens
PGPPPAFSLRFPWSLRGVRSRWAPGKMAAAAGDRGGEGGAGLGSAAGLGPGPGLRGQGPSAEAHEGAPDPMPAALHPEEVAARLQRMQRELSNRRKILVKNLPQDSNCQEVHDLLKDYDLKYCYVDRNKRTAFVTLLNGEQAQNAIQMFHQYSFRGKDLIVQLQPTDALLCITNVPISFTSEEFEELVRAYGNIERCFLVYSEVTGHSKGYGFVEYMKKDFAAKARLELLGRQLGASALFAQWMDVNLLASELIHSKCLCIDKLPSDYRDSEELLQIFSSVHKPVFCQLAQDEGSYVGGFAVVEYSTAEQAEEVQQAADGMTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQNLSHIPLAQQQLMKFENIHTNNKPGLLGEPPAVVLQTALGIGSVLPLKKELGHHHGEAHKTSSLIPTQTTITAGMGMLPFFPNQHIAGQAGPGHSNTQEKQPATVGMAEGNFSGSQPYLQSFPNLAAGSLLVGHHKQQQSQPKGTEISSGAASKNQTSLLGEPPKEIRLSKNPYLNLASVLPSVCLSSPASKTTLHKTGIASSILDAISQGSESQHALEKCIAYSPPFGDYAQVSSLRNEKRGSSYLISAPEGGSVECVDQHSQGTGAYYMETYLKKKRVY

SEQ ID NO: 806186 - protein, 458 aa, Homo sapiens
RASSRFLSPLSLEPPRSPQPLGAREDGGGGGRPRRRGGRGPGQRGALHPEEVAARLQRMQRELSNRRKILVKNLPQDSNCQEVHDLLKDYDLKYCYVDRNKRTAFVTLLNGEQAQNAIQMFHQYSFRGKDLIVQLQPTDALLCITNVPISFTSEEFEELVRAYGNIERCFLVYSEVTGHSKGYGFVEYMKKDFAAKARLELLGRQLGASALFAQWMDVNLLASELIHSKCLCIDKLPSDYRDSEELLQIFSSVHKPVFCQLAQDEGSYVGGFAVVEYSTAEQAEEVQQAADGMTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQNLSHIPLAQQQLMKFENIHTNNKPGLLGEPPAVVLQTALGIGSVLPLKKELGHHHGEAHKSCL

SEQ ID NO: 806187 - protein, 629 aa, Homo sapiens
RASSRFLSPLSLEPPRSPQPLGAREDGGGGGRPRRRGGRGPGQRGALHPEEVAARLQRMQRELSNRRKILVKNLPQDSNCQEVHDLLKDYDLKYCYVDRNKRTAFVTLLNGEQAQNAIQMFHQYSFRGKDLIVQLQPTDALLCITNVPISFTSEEFEELVRAYGNIERCFLVYSEVTGHSKGYGFVEYMKKDFAAKARLELLGRQLGASALFAQWMDVNLLASELIHSKCLCIDKLPSDYRDSEELLQIFSSVHKPVFCQLAQDEGSYVGGFAVVEYSTAEQAEEVQQAADGMTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQNLSHIPLAQQQLMKFENIHTNNKPGLLGEPPAVVLQTALGIGSVLPLKKELGHHHGEAHKTSSLIPTQTTITAGMGMLPFFPNQHIAGQAGPGHSNTQEKQPATVGMAEGNFSGSQPYLQSFPNLAAGSLLVGHHKQQQSQPKGTEISSGAASKNQTSLLGEPPKEIRLSKNPYLNLASVLPSVCLSSPASKTTLHKTGIASSILDAISQGSESQHALEKCIAYSPPFGDYAQV

SEQ ID NO: 806188 - protein, 676 aa, Homo sapiens
RASSRFLSPLSLEPPRSPQPLGAREDGGGGGRPRRRGGRGPGQRGALHPEEVAARLQRMQRELSNRRKILVKNLPQDSNCQEVHDLLKDYDLKYCYVDRNKRTAFVTLLNGEQAQNAIQMFHQYSFRGKDLIVQLQPTDALLCITNVPISFTSEEFEELVRAYGNIERCFLVYSEVTGHSKGYGFVEYMKKDFAAKARLELLGRQLGASALFAQWMDVNLLASELIHSKCLCIDKLPSDYRDSEELLQIFSSVHKPVFCQLAQDEGSYVGGFAVVEYSTAEQAEEVQQAADGMTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQNLSHIPLAQQQLMKFENIHTNNKPGLLGEPPAVVLQTALGIGSVLPLKKELGHHHGEAHKTSSLIPTQTTITAGMGMLPFFPNQHIAGQAGPGHSNTQEKQPATVGMAEGNFSGSQPYLQSFPNLAAGSLLVGHHKQQQSQPKGTEISSGAASKNQTSLLGEPPKEIRLSKNPYLNLASVLPSVCLSSPASKTTLHKTGIASSILDAISQGSESQHALEKCIAYSPPFGDYAQVSSLRNEKRGSSYLISAPEGGSVECVDQHSQGTGAYYMETYLKKKRVY

SEQ ID NO: 806189 - protein, 676 aa, Homo sapiens; identical to SEQ ID NO: 806188

SEQ ID NO: 806190 - protein, 629 aa, Homo sapiens; identical to SEQ ID NO: 806187

SEQ ID NO: 806191 - protein, 722 aa, Homo sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTAHGAPERPLAATSAAPPPQPQPQPPPQPEPRSVPQPEPEPEPEREATPTPAPAAPEEPPAPPEFRCQVCGQSFTQSWFLKGHMRKHKASFDHACPVCGRCFKEPWFLKNHMKVHASKLGPLRAPGPASGPARAPQPPDLGLLAYEPLGPALLLAPAPTPAERREPPSLLGYLSLRAGEGRPNGEGAEPGPGRSFGGFRPLSSALPARARRHRAEEPEEEEEVVEAEEETWARGRSLGSLASLHPRPGEGPGHSASAAGAQARSTATQEENGLLVGGTRPEGGRGATGKDCPFCGKSFRSAHHLKVHLRVHTGERPYKCPHCDYAGTQSGSLKYHLQRHHREQRSGAGPGPPPEPPPPSQRGSAPQSGAKPSPQPATWVEGASSPRPPSSGAGPGSRRKPASPGRTLRNGRGGEAEPLDLSLRAGPGGEAGPGGALHRCLFCPFATGAPELMALHLQVHHSRRARGRRPPQADASPPYARVPSGETPPSPSQEGEEGSGLSRPGEAGLGGQER

SEQ ID NO: 806192 - protein, 593 aa, Homo sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTAHGAPERPLAATSAAPPPQPQPQPPPQPEPRSVPQPEPEPEPEREATPTPAPAAPEEPPAPPEFRCQVCGQSFTQSWFLKGHMRKHKASFDHACPVCGRCFKEPWFLKNHMKVHASKLGPLRAPGPASGPARAPQPPDLGLLAYEPLGPALLLAPAPTPAERREPPSLLGYLSLRAGEGRPNGEGAEPGPGRSFGGFRPLSSALPARARRHRAEEPEEEEEVVEAEEETWARGRSLGSLASLHPRPGEGPGHSASAAGAQARSTATQEENGLLVGGTRPEGGRGATGKDCPFCGKSFRSAHHLKVHLRVHTGERPYKCPHCDYAGTQSGSLKYHLQRRPEEPPAPPEFRCQVCGQSFTQSWFLKGHMRKHKASFDHACPVCGR

SEQ ID NO: 806193 - protein, 361 aa, Homo sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTAHGAPERPLAATSAAPPPQPQPQPPPQPEPRSVPQPEPEPEPEREATPTPAPAAPEEPPAPPEFRCQVCGQSFTQSWFLKGHMRKHKASFDHACPVCGRCFKEPWFLKNHMKVHASKLGPLRAPGPASGPARAPQPPDLGLAPSSAPQPPG

SEQ ID NO: 806194 - protein, 655 aa, Homo sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSCQVCGQSFTQSWFLKGHMRKHKASFDHACPVCGRCFKEPWFLKNHMKVHASKLGPLRAPGPASGPARAPQPPDLGLLAYEPLGPALLLAPAPTPAERREPPSLLGYLSLRAGEGRPNGEGAEPGPGRSFGGFRPLSSALPARARRHRAEEPEEEEEVVEAEEETWARGRSLGSLASLHPRPGEGPGHSASAAGAQARSTATQEENGLLVGGTRPEGGRGATGKDCPFCGKSFRSAHHLKVHLRVHTGERPYKCPHCDYAGTQSGSLKYHLQRHHREQRSGAGPGPPPEPPPPSQRGSAPQSGAKPSPQPATWVEGASSPRPPSSGAGPGSRRKPASPGRTLRNGRGGEAEPLDLSLRAGPGGEAGPGGALHRCLFCPFATGAPELMALHLQVHHSRRARGRRPPQADASPPYARVPSGETPPSPSQEGEEGSGLSRPGEAGLGGQER

SEQ ID NO: 806195 - protein, 454 aa, Homo sapiens
MTKREAEELIEIEIDGTEKAECTEESIVEQTYAPAECVSQAIDINEPIGNLKKLLEPRLQCSLDAHEICLQDIQLDPERSLFDQGVKTDGTVQLSVQVISYQGIEPKLNILEIVKPADTVEVVIDPDAHHAESEAHLVEEAQVITLDGTKHITTISDETSEQVTRWAAALEGYRKEQERLGIPYDPIQWSTDQVLHWVVWVMKEFSMTDIDLTTLNISGRELCSLNQEDFFQRVPRGEILWSHLELLRKYVLASQEQQMNEIVTIDQPVQIIPASVQSATPTTIKVINSSAKAAKVQRAPRISGEDRSSPGNRTGNNGQIQLWQFLLELLTDKDARDCISWVGDEGEFKLNQPELVAQKWGQRKNKPTMNYEKLSRALRYYYDGDMICKVQGKRFVYKFVCDLKTLIGYSAAELNRLVTECEQKKLAKMQLHGIAQPVTAVALATASLQTEKDN

SEQ ID NO: 806196 - protein, 454 aa, Homo sapiens; identical to SEQ ID NO: 806195

SEQ ID NO: 806197 - protein, 454 aa, Homo sapiens; identical to SEQ ID NO: 806195

SEQ ID NO: 806198 - protein, 454 aa, Homo sapiens; identical to SEQ ID NO: 806195

SEQ ID NO: 806199 - protein, 96 aa, Homo sapiens
AQPSSAAPLPTRAPQLLRAFEPRWSSETRGGGEGESRLSRSRSRGFMRWPWKQPGRLPSLLVPSPERKVERPAGDQGRTESPGLVNSWAPRSPGIP

SEQ ID NO: 806200 - protein, 97 aa, Homo sapiens
PTFLCSALPTRAPQLLRAFEPRWSSETRGGGEGESRLSRSRSRGFMRWPWKQPGRLPSLLVPSPERKVERPAGDQGRTESPGLVNSWAPRSLFLSLC

SEQ ID NO: 806201 - protein, 96 aa, Homo sapiens; identical to SEQ ID NO: 806199

SEQ ID NO: 806202 - protein, 296 aa, Homo sapiens
MSGALDVLQMKEEDVLKFLAAGTHLGGTNLDFQMEQYICKRKSNGIYIINLKRTWEKLLLAASAIVAIENPAECQCYIPPGILARRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISCEHPWEVMPDLYFYRDPEEIEKEEQAAAEKAVTKEEFQGEWTAPAPEFTATQPEVADWSEGVQVPSVPIQQFPTEDWSAQPATEDWSAAPTAQATEWVGAPTDWS

SEQ ID NO: 806203 - protein, 118 aa, Homo sapiens
MDSSDETGSSFMSFWPHLQSDDLARNGITGFPYFSFIILNESDQILELDGTLVKIWLLVPSHQPATHFKFEETKTHGPYVITGDYPRSLWQKSVSSLPASPPCLWYFLPTLGCFCDHT

SEQ ID NO: 806204 - protein, 118 aa, Homo sapiens; identical to SEQ ID NO: 806203

SEQ ID NO: 806205 - protein, 118 aa, Homo sapiens; identical to SEQ ID NO: 806203

SEQ ID NO: 806206 - protein, 223 aa, Homo sapiens
MTWRHHVRLLFTVSLALQIINLGNSYQREKHNGGREEVTKVATQKHRQSPLNWTSSHFGEVTGSAEGWGPEEPLPYSRAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 806207 - protein, 223 aa, Homo sapiens; identical to SEQ ID NO: 806206

SEQ ID NO: 806208 - protein, 194 aa, Homo sapiens
MTWRHHVRLLFTVSLALQIINLGNSYQREKHNGGREEVTKVATQKHRQSPLNWTSSHFGEVTGSAEGWGPEEPLPYSRAFGEGASARPRCCRNGGTCVLGSFCVCPAHFTGRYCEHDQRRSECGALEHGAWTLRACHLCRCIFGALHCLPLQTPDRCGKRPCDSVPSSPPHAVAPSLRLTLHTDPQCIFQCQAT

SEQ ID NO: 806209 - protein, 261 aa, Homo sapiens
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 806210 - protein, 349 aa, Homo sapiens
EIKARYEAWWCSCPVLLTSSGLLGGRLFQFQVCRSVLSPRAAGCTWSLAPRSRGAAGSPRRYRGPQPQPAPPSALPNSRPSPVASGREMVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 806211 - protein, 261 aa, Homo sapiens; identical to SEQ ID NO: 806209

SEQ ID NO: 806212 - protein, 115 aa, Homo sapiens
MKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 806213 - protein, 115 aa, Homo sapiens; identical to SEQ ID NO: 806212

SEQ ID NO: 806214 - protein, 115 aa, Homo sapiens; identical to SEQ ID NO: 806212

SEQ ID NO: 806215 - protein, 261 aa, Homo sapiens; identical to SEQ ID NO: 806209

SEQ ID NO: 806216 - protein, 214 aa, Homo sapiens
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILEVGYLVYFVVLTLSKHKIMNLNGKLIGTNRMLFFFWLFKIR

SEQ ID NO: 806217 - protein, 173 aa, Homo sapiens
MIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 806218 - protein, 233 aa, Homo sapiens
MVVLSVPAEVTVILLDIEDILFPYIEDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 806219 - protein, 115 aa, Homo sapiens; identical to SEQ ID NO: 806212

SEQ ID NO: 806220 - protein, 217 aa, Homo sapiens
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTRGE

SEQ ID NO: 806221 - protein, 105 aa, Homo sapiens
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCSLGTRRV

SEQ ID NO: 806222 - protein, 105 aa, Homo sapiens
ELALARPWGKKSNWRNSWELGRWALSIGGLEPSDFYLKFLSLSCVGEMVTLPSGTWAFSCPYLALVDGGMLGSAREDAHETASRMLPRLALKAWPQAIFLPQPPK

SEQ ID NO: 806223 - protein, 124 aa, Homo sapiens
ELALARPWGKKSNWRNSWELGRWALSIGGLEPSDFYLKFLSLSCVGEMVTLPSGTWAFSCPYLALVDGGMLGSAREDAHETGTCCVAQAGLELLVLSNHTALATQSTGITGVNHHTQLLKPQYF

SEQ ID NO: 806224 - protein, 66 aa, Homo sapiens
ELALARPWGKKSNWRNSWELGRWALSIGGLEPSDFYLKFLSLSCVGEMSPLTMSGWRRLRCHEMAI

SEQ ID NO: 806225 - protein, 138 aa, Homo sapiens
LSQCYDSMLQTRKLSLSNPDILEQNNPLRDLVLKTLLEMDQTLPRPLSRPNTGITQESFVLTSHRRSLVKISSLAKSSWFHSSRSFSCPFQLSLSCSLVLKAVRGQEKTQLTKGSEIRVRTIQCGQLSELFITDRICS

SEQ ID NO: 806226 - protein, 294 aa, Homo sapiens
MAGILASGLGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTDVTVTCQGVEVLSTSWEEQRASHETLFCTKPLHQVFASFTRKGEKLDMSLVS

SEQ ID NO: 806227 - protein, 120 aa, Homo sapiens [sequence omitted]

SEQ ID NO: 806228 - protein, 300 aa, Homo sapiens
MEQANPLRPDGESKGGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTDVTVTCQGVEVLSTSWEEQRASHETLFCTKPLHQVFASFTRKGEKLDMSLVS

SEQ ID NO: 806229 - protein, 165 aa, Homo sapiens
MEQANPLRPDGESKGGVLAHLERLETQVSRSRKQSEELQSVQAQEGALGTKIHKLRRLRDELRAVVRHRRASVKACIANVEPNQTVEINEQEALEEKLENVKAILQAYHFTETTPDTSPFSPSLHSPGRDSCKIFTDQHPALPVQSLRVPECLLWEEVPGRPASE

SEQ ID NO: 806230 - protein, 254 aa, Homo sapiens
MAGILASGLGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTLVLPWHRLRECK

SEQ ID NO: 806231 - protein, 300 aa, Homo sapiens; identical to SEQ ID NO: 806228

SEQ ID NO: 806232 - protein, 300 aa, Homo sapiens; identical to SEQ ID NO: 806228

SEQ ID NO: 806233 - protein, 294 aa, Homo sapiens; identical to SEQ ID NO: 806226

SEQ ID NO: 806234 - protein, 126 aa, Homo sapiens
GVFLFASGLSGKLTSRGVCVCISTAFEGNLLDSYFVDLVIQKPLRIHHHSVPVFIPLEEIAAKYLQTNIQHFLFSLCEYLNAYSGRKYQADRLQVSLWDVICLIRGPKINLKGGCFLYFQCFLTVS

SEQ ID NO: 806235 - protein, 102 aa, Homo sapiens
MLYRLILRPTPCGRQMRKQAKKGHLQPTDLCSWKPSLSHLYPWSSLRLGLCKVSDSLPAPNTGFFFFSLRHAVSQLPRLKCSGEIMRHCRLDLPGSRDRPPK

SEQ ID NO: 806236 - protein, 122 aa, Homo sapiens
MLPRLFLNSWAQADDPLTLTSRSAGTYSCGFRKESAFMKGMAPQNHSPVGGIDFEGRLILGAKPPLFKVPSQPETLGETWVIAKMAGTYGGSRNTLPRSPGGNFRSRVPSPGRSRKDCPDSF

SEQ ID NO: 806237 - protein, 109 aa, Homo sapiens
MDKPCGCPPGVCDHGTGDRRDPWYSTVGLLPPVRAMSQRNLNAKTEQGPTGVTMTSNPITWGQIKKTTQEAEKLLERQGQAKTPDSMFLAMLAVVSCASIGSGEPPTGN

SEQ ID NO: 806238 - protein, 109 aa, Homo sapiens; identical to SEQ ID NO: 806237

SEQ ID NO: 806239 - protein, 74 aa, Homo sapiens
MSQRNLNAKTEQGPTGVTMTSNPITWGQIKKTTQEAEKLLERQGQAKTPDSMFLAMLAVVSCASIGSGEPPTGN

SEQ ID NO: 806240 - protein, 106 aa, Homo sapiens
KTQDKEIKGSWAWGTTTTNARRPVVAPNVWLRSYLLDTKQKGQGKECESSPMIGKVTWVMCPLVRGPFPACVDATCMCRCDLRCVSIPHTPYHHCLFALPPASGNH

SEQ ID NO: 806241 - protein, 44 aa, Homo sapiens
GDVLSKNIRTDDITSGYMTDGGLGLYTRRLNRLPDGMAVVRETL

SEQ ID NO: 806242 - protein, 66 aa, Homo sapiens
GGEGGRRRAEGEYRGEGFRKNSTFAEGTHSTEEDINKQINDKERVAAAMENPNLREIVEQCVLEPD

SEQ ID NO: 806243 - protein, 160 aa, Homo sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 806244 - protein, 181 aa, Homo sapiens
AVVSTQRGHYGRGRQGWLSVKMQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 806245 - protein, 102 aa, Homo sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIVGNLHF

SEQ ID NO: 806246 - protein, 160 aa, Homo sapiens; identical to SEQ ID NO: 806243

SEQ ID NO: 806247 - protein, 103 aa, Homo sapiens
MQRVSGLLSWTLSRVLWLSGLSEPGAARQPRIMEEKALEVYDLIRTIRDPEKPNTLEELEVVSESCVEVQEINEENFWGINKGYRKQPPFCFFGGIFYWAFCF

SEQ ID NO: 806248 - protein, 160 aa, Homo sapiens; identical to SEQ ID NO: 806243

SEQ ID NO: 806249 - protein, 160 aa, Homo sapiens; identical to SEQ ID NO: 806243

SEQ ID NO: 806250 - protein, 134 aa, Homo sapiens
MQRPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 806251 - protein, 102 aa, Homo sapiens; identical to SEQ ID NO: 806245

SEQ ID NO: 806252 - protein, 275 aa, Homo sapiens
EGKPSLSTTAREAPCCGHGWVTHRSDAWSPGAWTPAPRLPPAPPARGPASCASSAGHRRSWEAVSAVSLRHWQKTEAQRGRVTCLDHPRMSMPEHQAAPAAPPGLLQPHRPPTWNMAGVDCRDGAGAGHSPRSTCLAPASADGSPTAPSHVAKRVPTQPWLQLLQGWPETSQRRCCARSPGTPTWPDPADAAGPQPSQVRCRVPPPCAECPVTRTMPSSHVGRLWCPWGGDPDPRWALSISPVRTRLAALGIKTYRPTWEVPSPWSFHPSQLPPR

SEQ ID NO: 806253 - protein, 184 aa, Homo sapiens
MPEHQAAPAAPPGLLQPHRPPTWNMAGVDCRDGAGAGHSPRSTCLAPASADGSPTAPSHVAKRVPTQPWLQLLQGWPETSQRRCCARSPGTPTWPDPADAAGPQPSQVRCRVPPPCAECPVTRTMPSSHVGRLWCPWGGDPDPRWALSISPVRTRLAALGIKTYRPTWEVPSPWSFHPSQLPPR

SEQ ID NO: 806254 - protein, 48 aa, Homo sapiens
MAKPDASPDAVPQDGALWSAGYFCAQASGLSLLDAKLGKHSLISIHVT

SEQ ID NO: 806255 - protein, 92 aa, Homo sapiens
DCVRGGGMERSGKGRNLDLSSRPPRRRLPRAGPSVSETSSPSFTRLTWRVGRGRQPSAAEPPEGMSSALRLWPGLWSLQAVEGMLRPVPRGA

SEQ ID NO: 806256 - protein, 92 aa, Homo sapiens; identical to SEQ ID NO: 806255

SEQ ID NO: 806257 - protein, 171 aa, Homo sapiens
MILPTKAMATQELTVKRKLSGNTLQVQASSPVALGVRIPTVALHMMELFDTTVEQLYSIFTVKELVQKFSKSTAVLETEKGGKFQMFDGNITGEYLGLLTNKKIIMKWRCGNWPEEHYAMVALNFVPTLGQTELQLKEFLSICKEENMKFCWQKQHFEEIKGSLQLTPLNG

SEQ ID NO: 806258 - protein, 146 aa, Homo sapiens
MILPTKAMATQELTVKRKLSGNTLQVQASSPVALGVRIPTVALHMMELFDTTVEQLYSIFTVKEEERVCVLFSLTNKKIIMKWRCGNWPEEHYAMVALNFVPTLGQTELQLKEFLSICKEENMKFCWQKQHFEEIKGSLQLTPLNG

SEQ ID NO: 806259 - protein, 137 aa, Homo sapiens
MILPTKAMATQELTVKRKLSGNTLQVQASSPVALGVRIPTVALHMMELFDTTVEQLYSIFTVKELTNKKIIMKWRCGNWPEEHYAMVALNFVPTLGQTELQLKEFLSICKEENMKFCWQKQHFEEIKGSLQLTPLNG

SEQ ID NO: 806260 - protein, 92 aa, Homo sapiens; identical to SEQ ID NO: 806255

SEQ ID NO: 806261 - protein, 104 aa, Homo sapiens [sequence omitted]

SEQ ID NO: 806262 - protein, 946 aa, Homo sapiens
TERSLGGTQGPGQPCSCPGAMASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQLGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGAVLWTQDLGMPVMGVYTWHQDGLRQLPHLTLARDTLHFLALRWGHIRLPASGPQDTATLFSALDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGATRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARGPCPGATGR

SEQ ID NO: 806263 - protein, 782 aa, Homo sapiens
MTLTTEGPSTPRLYIGRTQYTVTMHDPRAPALRWNTTYRRYSAPPMDGSPGKYMSHLASCGMGLLLTVDPGSGAVLWTQDLGMPVMGVYTWHQDGLRQLPHLTLARDTLHFLALRWGHIRLPASGPQDTATLFSALDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGATRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARGPCPGATGR

SEQ ID NO: 806264 - protein, 793 aa, Homo sapiens
DGWACLRDSEASSGSSGCPRVQELGILPHHKENPPTQEDSSEASWNTTYRRYSAPPMDGSPGKYMSHLASCGMGLLLTVDPGSGAVLWTQDLGMPVMGVYTWHQDGLRQLPHLTLARDTLHFLALRWGHIRLPASGPQDTATLFSALDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGATRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARGPCPGATGR

SEQ ID NO: 806265 - protein, 749 aa, Homo sapiens
MTLTTEGPSTPRLYIGRTQYTVTMHDPRAPALRWNTTYRRYSAPPMDGSPGKYMSHLASCGMGLLLTVDPGSGAVLWTQDLGMPVMGVYTWHQDGLRQLPHLTLARDTLHFLALRWGHIRLPASGPQDTATLFSALDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGATRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARGPCPGATGR

SEQ ID NO: 806266 - protein, 328 aa, Homo sapiens
MTLTTEGPSTPRLYIGRTQYTVTMHDPRAPALRWNTTYRRYSAPPMDGSPGKYMSHLASCGMGLLLTVDPGSGAVLWTQDLGMPVMGVYTWHQDGLRQLPHLTLARDTLHFLALRWGHIRLPASGPQDTATLFSALDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPAWG

SEQ ID NO: 806267 - protein, 352 aa, Homo sapiens
MTLTTEGPSTPRLYIGRTQYTVTMHDPRAPALRWNTTYRRYSAPPMDGSPGKYMSHLASCGMGLLLTVDPGSGAVLWTQDLGMPVMGVYTWHQDGLRQLPHLTLARDTLHFLALRWGHIRLPASGPQDTATLFSALDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPALRKYKKKNIHICLMCIKPRKGQFRIQ

SEQ ID NO: 806268 - protein, 121 aa, Homo sapiens
LRSCSVSSCSLVRPSQSQILGPSRGRAWPGQSSLRLSCYSNSRRWWRSSRRPPWHLQTLLTSPRMPSPCTRGPPGGARRGFRVPQSKPSHSTTLKVSLCEQDRAVRNREKPGADLAAKLVY

SEQ ID NO: 806269 - protein, 104 aa, Homo sapiens
RHPYEPHPASIPALAQCLEGPPSLAKRCPHTPPPPEWQQPCLCAVTAYQALCKSISLFHPHGNPLREPPFNGSFAGGRERQRRAPSTVRTWRRGMEGGAGAGKH

SEQ ID NO: 806270 - protein, 222 aa, Homo sapiens [sequence omitted]

SEQ ID NO: 806271 - protein, 327 aa, Homo sapiens
AAAPFGSASLAPAGLFPRRGLWFVESNFPATSARLAGAPAWAPARTAGVVTMAASAGGPGSWSENILEYFLRNSQITAEDGAEITWYHAANHKAQTNEALKSTAHMIEADVLLPSDGSEHSQPIMAHPPETNSDNTLQEWLTEVMKSNKGIKLDFKSLAVVEPSMMLLENVKRHLKRPVWINADILPGPNGNSKVIDAKPFLDTVTSFFPDVTFSLGWTTGWHPEKVNEGYSWTMVKEMEYICNELSQPVTFPVRAALVRQSCSQLLWLLKKSNRYSLTIWTGKNDNYSVEDLLYIRDHFDKKQVFYDILEPQNHEFKQAIGIKVNL

SEQ ID NO: 806272 - protein, 116 aa, Homo sapiens
PVGVRHAAVRTRPGARARARVEAGLGVVAHELVLQERAGHGVAGPGHDLRARRVVGRGGQAVHVTAGVDPAGLFQKPLGKSRARSNHERLAFTRVLEPEVCCWKPPKYLVSIVSPV

SEQ ID NO: 806273 - protein, 341 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 806274 - protein, 341 aa, Homo sapiens; identical to SEQ ID NO: 806273

SEQ ID NO: 806275 - protein, 341 aa, Homo sapiens; identical to SEQ ID NO: 806273

SEQ ID NO: 806276 - protein, 170 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLSHAIS

SEQ ID NO: 806277 - protein, 309 aa, Homo sapiens [sequence omitted]

SEQ ID NO: 806278 - protein, 220 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTQPWLFGNGSGLAWRIFGIASLQCSQRCNQ

SEQ ID NO: 806279 - protein, 119 aa, Homo sapiens
SRACAGSAPTFLSGAAPGPCILGPACSPSAPSALRPVAQHPCSSRLPTMPAGVPMSTYLKMFAASLLAMCAGAEVVHRYYRPDLTIPEIPPKRGELKTELLGLKERKHKPQVSQQEELK

SEQ ID NO: 806280 - protein, 165 aa, Homo sapiens
MPAGVPMSTYLKMFAASLLAMCAGAEVVHRYYRPDLVLNSGLEHNVGSSHFCLDSAWTDEKQVEKSEVDFSKSHSLVRRFEDLKPKLSVCKTGSQVFRSENWKVWAESSRGDHDDCLDLCSVLCWGELLQTIPEIPPKRGELKTELLGLKERKHKPQVSQQEELK

SEQ ID NO: 806281 - protein, 165 aa, Homo sapiens; identical to SEQ ID NO: 806280

SEQ ID NO: 806282 - protein, 176 aa, Homo sapiens
MDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVRSGEWTEDEVLRRFLDNFDSSEKDGQVTLAEFQGLLQRRECLHEHG

SEQ ID NO: 806283 - protein, 176 aa, Homo sapiens; identical to SEQ ID NO: 806282

SEQ ID NO: 806284 - protein, 262 aa, Homo sapiens
MPPWRNSGHSACPAGPRASRAWPGELSPLTFLTPAPETTVPTVSPASRFFRQLDRDGSRSLDADEFRQGLAKLGLVLDQAEAEGVCRKWDRNGSGTLDLEEFLRALRVSPHLTVKACALGMGRQRMLRCGDGDSSLRAAVKRRLLGHTAPVLCTASWGFGCATHHPSHHLLSQPPMSQAREAVIAAAFAKLDRSGDGVVTVDDLRGVYSGRAHPKVRSGEWTEDEVLRRFLDNFDSSEKDGQVTLAEFQGLLQRRECLHEHG

SEQ ID NO: 806285 - protein, 176 aa, Homo sapiens; identical to SEQ ID NO: 806282

SEQ ID NO: 806286 - protein, 149 aa, Homo sapiens
MDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVTLAEFQGLLQRRECLHEHG

SEQ ID NO: 806287 - protein, 149 aa, Homo sapiens
MFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVRSGEWTEDEVLRRFLDNFDSSEKDGQVTLAEFQGLLQRRECLHEHG

SEQ ID NO: 806288 - protein, 598 aa, Homo sapiens
HTNCSKAWSGSSKAERTASGQRSRAEEEAVAAGGGTPRPLSPRALLWGVQLSTLGAKQAARRNQTVLLVVASPHSLEMANKGNKKRRQFSLEEKMKVVGAVDSGKRKGDVAKEFGITPSTLSTFLKDRTKFEEKVREASVGPQRKRMRSALYDDIDKAVFAWFQEIHAKNILVTGSVIRKKALNLANMLGYDNFQASVGWLNRFRDRHGIALKAVCREDSDRLMNGLGIDKINEWHAGEIIKLIADYSPDDIFNADETGVFFQLLPQHTLAAKGDHCRGGKKAKQRLTALFCCNASGTEKMRPLIVGRSASPHCLKNIHSLPCDYRANQWAWMTRDLFNEWLMQVDARMKRAERRILLLIDNCSAHNMLPHLERIQVGYLPSNCTAVLQPLNLGIIHTMKVLYQSHLLKQILLKLNSSEDQEEVDIKQAIDMIAAAWWSVKPSTVVKCWQKAGIVPMEFAECDTESAASEPDIAIEKLWHTVAIATCVPNEVNFQDFVTADDDLIISQDTDIIQDMVAGENTSEAGSEDEGEVSLPEQPKVTITEAISSVQKLRQFLSTCVDIPDAIFGQLNGIDEYLMKRVTQTLIDSKITDFLQTK

SEQ ID NO: 806289 - protein, 521 aa, Homo sapiens
MANKGNKKRRQFSLEEKMKVVGAVDSGKRKGDVAKEFGITPSTLSTFLKDRTKFEEKVREASVGPQRKRMRSALYDDIDKAVFAWFQEIHAKNILVTGSVIRKKALNLANMLGYDNFQASVGWLNRFRDRHGIALKAVCREDSDRLMNGLGIDKINEWHAGEIIKLIADYSPDDIFNADETGVFFQLLPQHTLAAKGDHCRGGKKAKQRLTALFCCNASGTEKMRPLIVGRSASPHCLKNIHSLPCDYRANQWAWMTRDLFNEWLMQVDARMKRAERRILLLIDNCSAHNMLPHLERIQVGYLPSNCTAVLQPLNLGIIHTMKVLYQSHLLKQILLKLNSSEDQEEVDIKQAIDMIAAAWWSVKPSTVVKCWQKAGIVPMEFAECDTESAASEPDIAIEKLWHTVAIATCVPNEVNFQDFVTADDDLIISQDTDIIQDMVAGENTSEAGSEDEGEVSLPEQPKVTITEAISSVQKLRQFLSTCVDIPDAIFGQLNGIDEYLMKRVTQTLIDSKITDFLQTK

SEQ ID NO: 806290 - protein, 80 aa, Homo sapiens
CGRACLPHLVRACDLTRPAAGRCIRAVGLLSVRFPPAAPAGIPPSVLATRSPLFPNRCSFSGALSRHGLTPLQSYLRSVL

SEQ ID NO: 806291 - protein, 80 aa, Homo sapiens
CGRACLPHLVRACDLTRPAAGRCIRAVGLLSVRFPPAAPAGIPPSVLATRSPLFPNRCSFSGALSRHGLTPLQSYLRTSD

SEQ ID NO: 806292 - protein, 134 aa, Homo sapiens
VKYRQELLERRLMEKKEVALQEAHEDKERARRLEALRKQVAVVAQFDPVRMMSDTMASKARMGIEIEEEFILQKPLFTLNTYNEQQIISDPRLRFELALREAGLHRTLYAKEILPKISPQKPPRKDMESTVFKI

SEQ ID NO: 806293 - protein, 134 aa, Homo sapiens; identical to SEQ ID NO: 806292

SEQ ID NO: 806294 - protein, 480 aa, Homo sapiens
FSVPLGRIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFSINFTMENQIHTGMEYDNGRFIGVKFKSVTFKDSVFKSCTFEDVTSVNTYFKNCTFIDTVFNNTDFEPYKFIDSEFKNCSFFHNKTGCQITFDDDYSAYWIYFVNFLGTLAVLPGNIVSALLMDRIGRLTMLGGSMVLSGISCFFLWFGTSESMMIGMLCLYNGLTISAWNSLDVVTVELYPTDRRATGFGFLNALCKAAAVLGNLIFGSLVSITKSIPILLASTVLVCGGLVGLCLPDTRTQVLM

SEQ ID NO: 806295 - protein, 259 aa, Homo sapiens
FSVPLGRIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFSINFTMENQIHTGMEYDNGRSRNLK

SEQ ID NO: 806296 - protein, 165 aa, Homo sapiens
MDAPRRDMELLSNSLAAYAHIRANPESFGLYFVLGVCFGLLLTLCLLVISISWAPRPRPRGPAQRRDPRSSTLEPEDDDEDEEDTVTRLGPDDTLPGPELSAEPDGPLNVNVFTSAEELERAQRLEERERILREIWRTGQPDLLGTGTLGPSPTATGTLGRMHYY

SEQ ID NO: 806297 - protein, 165 aa, Homo sapiens; identical to SEQ ID NO: 806296

SEQ ID NO: 806298 - protein, 165 aa, Homo sapiens; identical to SEQ ID NO: 806296

SEQ ID NO: 806299 - protein, 102 aa, Homo sapiens
MDAPRRDMELLSNSLAAYAHIRANPESFGLYFVLGVCFGLLLTLCLLVISISWAPRPRPRGPAQRRDPRSSTLEPEDDDEDEEDTVTRLGPDDTLPGYRTCT

SEQ ID NO: 806300 - protein, 165 aa, Homo sapiens; identical to SEQ ID NO: 806296

SEQ ID NO: 806301 - protein, 165 aa, Homo sapiens; identical to SEQ ID NO: 806296

SEQ ID NO: 806302 - protein, 172 aa, Homo sapiens
PPGSGALTAGRGAAPQSSMDAPRRDMELLSNSLAAYAHIRANPESFGLYFVWAPTTRCRAPSCPQSRTGPSTSTSSRRRRSWSGRSGWRSANGSCGRSGAPGSRTCWAQARWGPAPRPRAPWAACTITDGPRLPLQGARGTGPAHELRATPHLRTASAPTAPRCYWAWTATP

SEQ ID NO: 806303 - protein, 164 aa, Homo sapiens
VAPGSAAAEVWGPGLASEGAVGSPMGLSKSKEKPRKGEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 806304 - protein, 109 aa, Homo sapiens
MEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 806305 - protein, 119 aa, Homo sapiens
VAPGSAAAEVWGPGLASEGAVGSPMGLSKSKEKPRKGEEQKKGSTYSVPKSKEKLMEKHSQEARQADRESEKPVDSLHPGAGTAKHPPPAASLEGRRRREGAKRGQWLGGSGAGVRSLL

SEQ ID NO: 806306 - protein, 119 aa, Homo sapiens; identical to SEQ ID NO: 806305

SEQ ID NO: 806307 - protein, 164 aa, Homo sapiens; identical to SEQ ID NO: 806303

SEQ ID NO: 806308 - protein, 164 aa, Homo sapiens; identical to SEQ ID NO: 806303

SEQ ID NO: 806309 - protein, 97 aa, Homo sapiens
VAPGSAAAEVWGPGLASEGAVGSPMGLSKSKEKPRKGEEQKKGSTYSVPKSKEKLMEKHSQEARQADRESEKPVDSLHPGAGTAKHPPPAASLEVTG

SEQ ID NO: 806310 - protein, 97 aa, Homo sapiens; identical to SEQ ID NO: 806309

SEQ ID NO: 806311 - protein, 104 aa, Homo sapiens
VAPGSAAAEVWGPGLASEGAVGSPMGLSKSKEKPRKGEEQKKGSTYSVPKSKEKLMEKHSQEARQADRESEKPVDSLHPGAGTAKHPPPAASLEVNECHEIRWF

SEQ ID NO: 806312 - protein, 97 aa, Homo sapiens; identical to SEQ ID NO: 806309

SEQ ID NO: 806313 - protein, 106 aa, Homo sapiens
VAPGSAAAEVWGPGLASEGAVGSPMGLSKSKEKPRKEKPDVKQKSSRKKVVVPQIIITRASNETLVSCSSSGSDQQRTIREPEDWGPYRRHRNPSTADAYNSHLKE

SEQ ID NO: 806314 - protein, 97 aa, Homo sapiens; identical to SEQ ID NO: 806309

SEQ ID NO: 806315 - protein, 65 aa, Homo sapiens
RPTHVPLPNACAAPQRMCRSQRMCRSQRMCRSQRMCRSQRMCRSQQHVPLLFNWNLMDPMWFPPS

SEQ ID NO: 806316 - protein, 72 aa, Homo sapiens
TYDFVTLQWCKSGKNSAFSSTSGRASTVLSQRLSLLPAARLSARRPHPDAVAQTLSLSWSFPPNPALNTLRR

SEQ ID NO: 806317 - protein, 593 aa, Homo sapiens
VELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEGTEWPHAGGHVCVRVCICVCMHICVCVCICFIYKQAGWAAVGSAGGWRCVCLCECVCVHVCVCTSVCIYVSYTSKQAGQQ

SEQ ID NO: 806318 - protein, 734 aa, Homo sapiens
VELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEGTEWPHAGGHVCVRVCICVCMHICVCVCICFIYKQAGWAAVGSAGGWRCVCLCECVCVHVCVCTSVCIYVSYTSKQAGQQCAVLEAVYVSVCVRICVCVYVSCTSKQAGQQWAVLEALCVRVHVCVCMCMCSIYKQAGQATVSSAGGCVRVCVCMCMCFIYKQAGQAAVGNAGGCASYLHTCKASHSIVPMPVSQTTPIPKQAPPWQHQRGQGLLALSLKV

SEQ ID NO: 806319 - protein, 809 aa, Homo sapiens
VELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMVSLGQQLIWLGAGHRAHYHDCWAPLELCEQTQGKGLPCNLPQFMRLLSYVSESTAFEVWKTWIQIQTFLCLAVWFQTLTLSDLKPSRGPMSGGTQVTITGTNLNAGSNVVVMFGKQPCLFHRRSPSYIVCNTTSSDEVLEMKVSVQVDRAKNPTTSCFVMWRTTPPSVRSSTKDHCGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEGTEWPHAGGHVCVRVCICVCMHICVCVCICFIYKQAGWAAVGSAGGWRCVCLCECVCVHVCVCTSVCIYVSYTSKQAGQQCAVLEAVYVSVCVRICVCVYVSCTSKQAGQQWAVLEALCVRVHVCVCMCMCSIYKQAGQATVSSAGGCVRVCVCMCMCFIYKQAGQAAVGNAGGCASYLHTCKASHSIVPMPVSQTTPIPKQAPPWQHQRGQGLLALSLKV

SEQ ID NO: 806320 - protein, 177 aa, Homo sapiens
KKLQSMKTQTVTKPAREEHTFDLQRSFMANTGTARWLPTTHTGTQNAPNIMRLLRRADFHVGAHVNTFWRTPCRGATEGLSKKSVVWENKHITWFGECGGAGVSGWGALGLAWLTTKTLTLPLPATLDGGIGLLLPMQEKTYRRLLMLQNALTTMLPHHAGLNPRAFRMLHADALKG

SEQ ID NO: 806321 - protein, 141 aa, Homo sapiens
CLHAGHMLPLLQLDPGIGNSLPADRGDELDGEGLLLGADVPLISLDGLKGYVAAGTCLMQGEEVTCRGRILIMDVIEVVPEPGQPLTKNKFKVLYEKEQKGPVTALCHCNGHLGLPIRARNLSHLAPPANRSDAIPSSIRY

SEQ ID NO: 806322 - protein, 944 aa, Homo sapiens
AAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEEPRRVSGACACCVGQTSTWVPT

SEQ ID NO: 806323 - protein, 932 aa, Homo sapiens
MEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEEPRRVSGACACCVGQTSTWVPT

SEQ ID NO: 806324 - protein, 984 aa, Homo sapiens
MEPGYLFLGSRLGNSLLLKYTEKLQEPPASAVREAADKVGFLGPLGHHPSCGHCCGMPLSAPPASQEEPPSKKKRVDATAGWSAAGKSVPQDEVDEIEVYGSEAQSGTQLATYSFEVRLRQQGPRPSQRPQRAPDSCCAQVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEEPRRVSGACACCVGQTSTWVPT

SEQ ID NO: 806325 - protein, 862 aa, Homo sapiens
LEDLSRSRREHSWPLSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEEPRRVSGACACCVGQTSTWVPT

SEQ ID NO: 806326 - protein, 1209 aa, Homo sapiens
AAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQVGSGRFPTHWLMLPQLGAEGEGTGEGTIGSTLRTMKECPEGDGVEVNEVETCDLVAPKVWKGVVGNWGCIPWGPHHCSAGSPGKPSQGLASTLLRRADVSASSAPWLLCDFGRAHRLSHPGSLFKPPHHQVTGDPAWDAVSASWVPEDSGLSMKEGSPGSLCLVFSPQHGSLWAALCSLQCPPGLAFPSPVASTPSPSCAWENGQEEPQRLSGSPFQDLARTQLPLTHPCSHRAEGNIPGLLAAWACLPLPLASPGSPAPVPPPQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEEPRRVSGACACCVGQTSTWVPT

SEQ ID NO: 806327 - protein, 952 aa, Homo sapiens
AAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEPAPLWPWQEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEEPRRVSGACACCVGQTSTWVPT

SEQ ID NO: 806328 - protein, 898 aa, Homo sapiens
AAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHTAWRCTSPRCTIPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEEPRRVSGACACCVGQTSTWVPT

SEQ ID NO: 806329 - protein, 747 aa, Homo sapiens
HLEDPQLRRRITDSDLSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEEPRRVSGACACCVGQTSTWVPT

SEQ ID NO: 806330 - protein, 970 aa, Homo sapiens
AAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRVHLWRRCSCLGGYPPKAPLTPPSRPQDAKPLEVYSVDFMVDNAQLGFLVSDRDRNLMVYMYLPEEPRRVSGACACCVGQTSTWVPT

SEQ ID NO: 806331 - protein, 944 aa, Homo sapiens; identical to SEQ ID NO: 806322

SEQ ID NO: 806332 - protein, 978 aa, Homo sapiens
AAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMKYMPGEAGSPKESENVVVLEDTAYQEQTDRELVYVGLGAGALGLVGAALFFLPRRRRHEAVAA

SEQ ID NO: 806333 - protein, 678 aa, Homo sapiens
AAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQAAEDQCLLLTVYDANGCREIRWVRHYCSREVKVCVGTHNAWPATHMGER

SEQ ID NO: 806334 - protein, 150 aa, Homo sapiens
SFVGTRSYMAPERLQGTHYSVRSDIWSMLSLVELAVRKVPLPPAVSTLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 806335 - protein, 287 aa, Homo sapiens
FPSAGCFSLATPRLCQRYRTLSGGNLLTAKNYLLQLHRHLLRAADRWVPAPLVSQFRGCPPPSPARSIIGEGSLRFLRRAFARCVLRSQWNRWSQGWFHQVGRFLALAPLCAFAGPGRSQHREVLSKGDCLSWLGKLLWDDSFLEVSSLAQLAVSGSQNHCCAELDVLLWPRMFLCGIPTAVVEIAVFLWPHRHVGNFFSGCGVLSTELLVLIHAFSQRADETLFCLCQLLVVLCTVSSSRCGAFSIRGPLVPASRSQHPAFPLALSPAARSRRFCCHSTCCTEFLG

SEQ ID NO: 806336 - protein, 139 aa, Homo sapiens
FPSAGCFSLATPRLCQRYRTLSGGNLLTAKNYLLQLHRHLLRAADRWVPAPLVSQFRGCPPPSPARSIIGEGSLRFLRRAFARCVLRSQWNRWSQGNYDRSNLQGFRSDRNILMVGIASLSHICNFFFVGLVLCNFCLP

SEQ ID NO: 806337 - protein, 119 aa, Homo sapiens
WFSPVQYRLGPPEKLNDGSLCPPPSWAHPGDPPILASQIAGDLGIVLCFVCLFFSIPTLSLFPQYIEFCWFLFFGFFFPLSLMLLPVHCSCCCFRFLSPRLKCSYLITANYSLDLPGLR

SEQ ID NO: 806338 - protein, 120 aa, Homo sapiens
GEFPGSSCPVSVRKIKERCSDTVAWPFIHKTTRAVCAAPLPATSLMAAHYPFVDCQLQTSPSFPRCVRTRLNSVSFASWPVPFSPDLYAKQSEILLSNHYTTSEVRVFGVPEVLENLEAL

SEQ ID NO: 806339 - protein, 120 aa, Homo sapiens; identical to SEQ ID NO: 806338

SEQ ID NO: 806340 - protein, 291 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 806341 - protein, 146 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSGQWRKAPGWTWEGQDG

SEQ ID NO: 806342 - protein, 291 aa, Homo sapiens; identical to SEQ ID NO: 806340

SEQ ID NO: 806343 - protein, 310 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 806344 - protein, 291 aa, Homo sapiens; identical to SEQ ID NO: 806340

SEQ ID NO: 806345 - protein, 310 aa, Homo sapiens; identical to SEQ ID NO: 806343

SEQ ID NO: 806346 - protein, 146 aa, Homo sapiens; identical to SEQ ID NO: 806341

SEQ ID NO: 806347 - protein, 303 aa, Homo sapiens
MGILSFLPVLATESDWADCKSPQPWGHMLLWTAVLFLAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 806348 - protein, 377 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGVSDPSHLPLPSPLLPFLLPSFLGPLCGSLLLVSAFSRLRTQSPIHFSCTRMLWKSLMTRTVFSLHCLALGFEKKIREGRSGISWPKFPLGRTGRCCSSKREGFFQSHLPES

SEQ ID NO: 806349 - protein, 323 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANSTDPVKAAQFEPPGRQMIAIRKRQPEETNNDYETADGGYMTLNPRAPTDDDKNIYLTLPPNDHVNSNN

SEQ ID NO: 806350 - protein, 356 aa, Homo sapiens
SICALNSGFFCWLYRSGVPGHLLCSGRHSLQGVMGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANSTDPVKAAQFEPPGRQMIAIRKRQPEETNNDYETADGGYMTLNPRAPTDDDKNIYLTLPPNDHVNSNN

SEQ ID NO: 806351 - protein, 267 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISATWTSNDCHQKETT

SEQ ID NO: 806352 - protein, 234 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQGPRLRTAAKQSSLVGAEVP

SEQ ID NO: 806353 - protein, 237 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQGMRSLPRCREGRRGDGQGLRSH

SEQ ID NO: 806354 - protein, 352 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQGPRLRTAAKQSSLVGAEVPYSSWAFVRTEAPSSSPMGIIVAVVTGIAVAAIVAAVVALIYCRKKRISANSTDPVKAAQFEPPGRQMIAIRKRQPEETNNDYETADGGYMTLNPRAPTDDDKNIYLTLPPNDHVNSNN

SEQ ID NO: 806355 - protein, 606 aa, Homo sapiens
MAVTFEDVTIIFTWEEWKFLDSSQKRLYREVMWENYTNVMSVENWNESYKSQEEKFRYLEYENFSYWQGWWNAGAQMYENQNYGETVQGTDSKDLTQQDRSQCQEWLILSTQVPGYGNYELTFESKSLRNLKYKNFMPWQSLETKTTQDYGREIYMSGSHGFQGGRYRLGISRKNLSMEKEQKLIVQHSYIPVEEALPQYVGVICQEDLLRDSMEEKYCGCNKCKGIYYWNSRCVFHKRNQPGENLCQCSIRKACFSQRSDLYRHPRNHIGKKLYGCDEVDGNFHQSSGVHFHQRVHIGEVPYSCNACGKSFSQISSLHNHQRVHTEEKFYKIECDKDLSRNSLLHIHQRLHIGEKPFKCNQCGKSFNRSSVLHVHQRVHTGEKPYKCDECGKGFSQSSNLRIHQLVHTGEKSYKCEDCGKGFTQRSNLQIHQRVHTGEKPYKCDDCGKDFSHSSDLRIHQRVHTGEKPYTCPECGKGFSKSSKLHTHQRVHTGEKPYKCEECGKGFSQRSHLLIHQRVHTGEKPYKCHDCGKGFSHSSNLHIHQRVHTGEKPYQCAKCGKGFSHSSALRIHQRVHAGEKPYKCREYYKGFDHNSHLHNNHRRGNL

SEQ ID NO: 806356 - protein, 198 aa, Homo sapiens
QERPAGGGRPAPRPRPGAGRSPPSRRSRFQQDGQARGQRPQSPPAAAFSPAVPVGALAQHVPAAEVQLVAGLALAALVAGAEAHRGHGHHPPGGGAATAHRAGRRLGLRVPEALLRLHLLQQETLGPGALQHVPEPGLRQLHVAAQVLQEHAAAVGAQHLETGSPHVAQAGLELLKRSTCLSLPEHWNYRREPPRGAC

SEQ ID NO: 806357 - protein, 112 aa, Homo sapiens
KGLLSRSCIARMGGENLALESLSLFLLFYVPHVSFYNCFLRFAPSAPSPHHISPRRVPAPSSILQRTQPPYTQQPSGSHLKSYQPETNSSFQPNGIHVHGKQEAGSPLSFEK

SEQ ID NO: 806358 - protein, 176 aa, Homo sapiens
LRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGKQEAGSPLSFEK

SEQ ID NO: 806359 - protein, 458 aa, Homo sapiens
MATESPATRRVQVAEHPRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 806360 - protein, 458 aa, Homo sapiens; identical to SEQ ID NO: 806359

SEQ ID NO: 806361 - protein, 458 aa, Homo sapiens; identical to SEQ ID NO: 806359

SEQ ID NO: 806362 - protein, 458 aa, Homo sapiens; identical to SEQ ID NO: 806359

SEQ ID NO: 806363 - protein, 458 aa, Homo sapiens; identical to SEQ ID NO: 806359

SEQ ID NO: 806364 - protein, 447 aa, Homo sapiens
MPVLYDRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 806365 - protein, 434 aa, Homo sapiens
MFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 806366 - protein, 329 aa, Homo sapiens [sequence omitted]

SEQ ID NO: 806367 - protein, 329 aa, Homo sapiens [sequence omitted]

SEQ ID NO: 806368 - protein, 404 aa, Homo sapiens
MATESPATRRVQVAEHPRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRCFGNTSQLMHLKII

SEQ ID NO: 806369 - protein, 485 aa, Homo sapiens
MATESPATRRVQVAEHPRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDGLGIFINFPKFSQTHHTSSATVSMGENVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 806370 - protein, 434 aa, Homo sapiens; identical to SEQ ID NO: 806365

SEQ ID NO: 806371 - protein, 387 aa, Homo sapiens
LGSLCYLHLQANTMPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 806372 - protein, 505 aa, Homo sapiens
MTCGSGFGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEIRILQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGIGAVNVCVSSSRGGVVCGDLCVSGSRPVTGSVCSAPCNGNVAVSTGLCAPCGQLNTTCGGGSCGVGSCGISSLGVGSCGSSCRKC

SEQ ID NO: 806373 - protein, 137 aa, Homo sapiens
LLQSLYSIPFQRLLRHWGCECLCQQLPGRGRVRGPLRVRLPASDWQCLQRSVQRERGGEHRPVCALRPIEHHLRRGFLRRGLLWYQLPGCGVLRQQLPEMLGTPTQVPGPRHLSCPALLGPSSPGAWSKCSATSPAL

SEQ ID NO: 806374 - protein, 505 aa, Homo sapiens; identical to SEQ ID NO: 806372

SEQ ID NO: 806375 - protein, 189 aa, Homo sapiens
MARLGKREGILRSTCSYSWKGRSTTQNSKLEAAVAQSEQQGEAALSDARCKLAELEGALQKAKQDMACLIREYQEVMNSKLGLDIEIATYRRLLEGEEQRLCEGIGAVNVCVSSSRGGVVCGDLCVSGSRPVTGSVCSAPCNGNVAVSTGLCAPCGQLNTTCGGGSCGVGSCGISSLGVGSCGSSCRKC

SEQ ID NO: 806376 - protein, 303 aa, Homo sapiens
MTCGSGFGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEIRILQSHISDTSVVVKLDNSRDLNMDCIIAEIKAQYDDIVTRSRAEPSASGSCGSAR

SEQ ID NO: 806377 - protein, 505 aa, Homo sapiens; identical to SEQ ID NO: 806372

SEQ ID NO: 806378 - protein, 236 aa, Homo sapiens
MFPCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGIGAVNVCVSSSRGGVVCGDLCVSGSRPVTGSVCSAPCNGNVAVSTGLCAPCGQLNTTCGGGSCGVGSCGISSLGVGSCGSSCRKC

SEQ ID NO: 806379 - protein, 98 aa, Homo sapiens
RLKSIPGSRLCEGIWGFNVCVSSSRGGVVCGDLCVSGSRPVTGSVCSAPCNGNVAVSTGLCAPCGQLNTTCGGGSCGVGSCGISSLGVGSCGSSCRKC

SEQ ID NO: 806380 - protein, 315 aa, Homo sapiens
STHASADAWVDPRVACRMWGACKVKVHDSLATISITLRRYLRLGATMAKSKFEYVRDFEADDTCLAHCWVVVRLDGRNFHRFAEKHNFAKPNDSRALQLMTKCAQTVMEELEDIVIAYGQSDEYSFVFKRKTNWFKRRASKFMTHVASQFASSYVFYWRDYFEDQPLLYPPGFDGRVVVYPSNQTLKDYLSWRQADCHINNLYNTVFWALIQQSGLTPVQAQGRLQGTLAADKNEILFSEFNINYNNELPMYRKGTVLIWQKVDEVMTKEIKLPTEMEGKKMAVTRTRTKPVPLHCDIIGDAFWKEHPEILDEDS

SEQ ID NO: 806381 - protein, 300 aa, Homo sapiens
STHASADAWVDPRVACRMWGACKVKVHDSLATISITLRRYLRLGATMAKSKFEYVRDFEADDTCLAHCWVVVRLDGRNFHRFAEKHNFAKPNDSRALQLMTKCAQTVMEELEDIVIAYGQSDEYSFVFKRKTNWFKRRASKFMTHVASQFASSYVFYWRDYFEDQPLLYPPGFDGRVVVYPSNQTLKDYLSWRQADCHINNLYNTVFWALIQQSGLTPVQAQGRLQGTLAADKNEILFSEFNINYNNELPMYRKGTVLIWQKVDEVMTKEIKLPTEMEGKKMAVTRTRTKPPPTSQGSLP

SEQ ID NO: 806382 - protein, 172 aa, Homo sapiens
STHASADAWVDPRVACRMWGACKVKVHDSLATISITLRRYLRLGATMAKSKFEYVRDFEADDTCLAHCWVVVRLDGRNFHRFAEKHNFAKPNDSRALQLMTKCAQTVMEELEDIVIAYGQSDEYSFVFKRKTNWFKRRASMCFIGGITLRTSPFCIPQALTEESWCIPATRL

SEQ ID NO: 806383 - protein, 315 aa, Homo sapiens; identical to SEQ ID NO: 806380

SEQ ID NO: 806384 - protein, 315 aa, Homo sapiens; identical to SEQ ID NO: 806380

SEQ ID NO: 806385 - protein, 141 aa, Homo sapiens
STHASADAWVDPRVACRMWGACKVKVHDSLATISITLRRYLRLGATMAKSKFEYVRDFEADDTCLAHCWVVVRLDGRNFHRFAEKHNFAKPNDSRALQLMTKCAQTVMEELEDIVIAYGQSDEYSFVFKRKTNWFKRRARL

SEQ ID NO: 806386 - protein, 267 aa, Homo sapiens
VSTSVRPRWKTRAAAPGCLQRPGPERKLNHLSPEMSSESKEQHNVSPRDSAEGNDSYPSGIHLELQRESSTDFKQFETNDQCRPYHRILIERQEKSDTNFKEFVIKKLQKNCQCSPAKAKNMILGFLPVLQWLPKYDLKKNILGDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQ

SEQ ID NO: 806387 - protein, 773 aa, Homo sapiens
VSTSVRPRWKTRAAAPGCLQRPGPERKLNHLSPEMSSESKEQHNVSPRDSAEGNDSYPSGIHLELQRESSTDFKQFETNDQCRPYHRILIERQEKSDTNFKEFVIKKLQKNCQCSPAKAKNMILGFLPVLQWLPKYDLKKNILGDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQVAMGFFQVGFVSVYLSDALLSGFVTGASFTILTSQAKYLLGLNLPRTNGVGSLITTWIHVFRNIHKTNLCDLITSLLCLLVLLPTKELNEHFKSKLKAPIPIELVVVVAATLASHFGKLHENYNSSIAGHIPTGFMPPKVPEWNLIPSVAVDAIAISIIGFAITVSLSEMFAKKHGYTVKANQEMYAIGFCNIIPSFFHCFTTSAALAKTLVKESTGCHTQLSGVVTALVLLLVLLVIAPLFYSLQKSVLGVITIVNLRGALRKFRDLPKMWSISRMDTVIWFVTMLSSALLSTEIGLLVGVCFSIFCVILRTQKPKSSLLGLVEESEVFESVSAYKNLQTKPGIKIFRFVAPLYYINKECFKSALYKQTVNPILIKVAWKKAAKRKIKEKVVTLGGIQDEMSVQLSHDPLELHTIVIDCSAIQFLDTAGIHTLKEVRRDYEAIGIQVLLAQCNPTVRDSLTNGEYCKKEEENLLFYSVYEAMAFAEVSKNQKGVCVPNGLSLSSD

SEQ ID NO: 806388 - protein, 126 aa, Homo sapiens
MFHSVTFFFRQVPWSLDKSELEFDSDSQRGDAYIMWLHRGELPDKQRTQCIPPLTCLWEWVALQGFIKMKSYPSSTNVETVNDGAESAMFKQLFQKWSVKDQTMGLGKTFSIGKIGETAPRSSSHC

SEQ ID NO: 806389 - protein, 938 aa, Homo sapiens
VPGQWPNTELHFPACSRRPLNSEAGGRFRLHQRGIHGEMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 806390 - protein, 938 aa, Homo sapiens; identical to SEQ ID NO: 806389

SEQ ID NO: 806391 - protein, 281 aa, Homo sapiens
GNTLYLCGTDEYGTATETKALEEARVPGKDIGTEQHNQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEDAGGEDISLGSDSDTPKTKNTSTVQEPEDRLKANAAVTPSNSNGAKPMDPEKDKKTKAYKDIEKDAPKAHRSITGKQHTNPGE

SEQ ID NO: 806392 - protein, 914 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 806393 - protein, 914 aa, Homo sapiens; identical to SEQ ID NO: 806392

SEQ ID NO: 806394 - protein, 958 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVSSSWLGCAWGGEAVGCGCKGWVSGLPWAFEGGLRKSLLTTFPKVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 806395 - protein, 914 aa, Homo sapiens; identical to SEQ ID NO: 806392

SEQ ID NO: 806396 - protein, 560 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQP

SEQ ID NO: 806397 - protein, 882 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQSMKLKPCGRLDKLNPK

SEQ ID NO: 806398 - protein, 879 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGETLGSKETVGCS

SEQ ID NO: 806399 - protein, 835 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQ

SEQ ID NO: 806400 - protein, 776 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPAVSC

SEQ ID NO: 806401 - protein, 349 aa, Homo sapiens [sequence omitted]

SEQ ID NO: 806402 - protein, 734 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGRNSWI

SEQ ID NO: 806403 - protein, 835 aa, Homo sapiens; identical to SEQ ID NO: 806399

SEQ ID NO: 806404 - protein, 879 aa, Homo sapiens; identical to SEQ ID NO: 806398

SEQ ID NO: 806405 - protein, 882 aa, Homo sapiens; identical to SEQ ID NO: 806397

SEQ ID NO: 806406 - protein, 835 aa, Homo sapiens; identical to SEQ ID NO: 806399

SEQ ID NO: 806407 - protein, 819 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVGGRASLS

SEQ ID NO: 806408 - protein, 602 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATGTYH

SEQ ID NO: 806409 - protein, 440 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKWRNSWI

SEQ ID NO: 806410 - protein, 535 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKAMRWLTKV

SEQ ID NO: 806411 - protein, 1010 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSFNRGDVFLLDLGKVIIQWNGPESNSGERLKAMLLAKDIRDRERGGRAEIGVIEGDKEAASPELMKVLQDTLGRRSIIKPTVPDEIIDQKQKSTIMLYHISDSAGQLAVTEVATRPLVQDLLNHDDCYILDQSGTKIYVWKGKGATKAEKQAAMSKALGFIKMKSYPSSTNVETVNDGAESAMFKQLFQKWSVKDQTMGLGKTFSIGKIAKVFQDKFDVTLLHTKPEVAAQERMVDDGNGKVEVWRIENLELVPVEYQWYGFFYGGDCYLVLYTYEVNGKPHHILYIWQGRHASQDELAASAYQAVEVDRQFDGAAVQVRVRMGTEPRHFMAIFKGKLVIFEGGTSRKGNAEPDPPVRLFQIHGNDKSNTKAVEVPAFASSLNSNDVFLLRTQAEHYLWYGKVGWLGPGSDQPLGAQTCTPLLLSARSKDLE

SEQ ID NO: 806412 - protein, 1142 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSFNRGDVFLLDLGKVIIQWNGPESNSGERLKAMLLAKDIRDRERGGRAEIGVIEGDKEAASPELMKVLQDTLGRRSIIKPTVPDEIIDQKQKSTIMLYHISDSAGQLAVTEVATRPLVQDLLNHDDCYILDQSGTKIYVWKGKGATKAEKQAAMSKALGFIKMKSYPSSTNVETVNDGAESAMFKQLFQKWSVKDQTMGLGKTFSIGKIAKVFQDKFDVTLLHTKPEVAAQERMVDDGNGKVEVWRIENLELVPVEYQWYGFFYGGDCYLVLYTYEVNGKPHHILYIWQGRHASQDELAASAYQAVEVDRQFDGAAVQVRVRMGTEPRHFMAIFKGKLVIFEGGTSRKGNAEPDPPVRLFQIHGNDKSNTKAVEVPAFASSLNSNDVFLLRTQAEHYLWYGKGSSGDERAMAKELASLLCDGSENTVAEGQEPAEFWDLLGGKTPYANDKRYGNTASPSSGLPLPARLVNCTKAKTSVLKTFLSSLMPLNGLYCRLQQEILDVQSRLFECSNKTGQFVVTEITDFTQDDLNPTDVMLLDTWDQVRHSCRSQNMRKTPTVRVVFV

SEQ ID NO: 806413 - protein, 1039 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSFNRGDVFLLDLGKVIIQWNGPESNSGERLKAMLLAKDIRDRERGGRAEIGVIEGDKEAASPELMKVLQDTLGRRSIIKPTVPDEIIDQKQKSTIMLYHISDSAGQLAVTEVATRPLVQDLLNHDDCYILDQSGTKIYVWKGKGATKAEKQAAMSKALGFIKMKSYPSSTNVETVNDGAESAMFKQLFQKWSVKDQTMGLGKTFSIGKIAKVFQDKFDVTLLHTKPEVAAQERMVDDGNGKVEVWRIENLELVPVEYQWYGFFYGGDCYLVLYTYEVNGKPHHILYIWQGRHASQDELAASAYQAVEVDRQFDGAAVQVRVRMGTEPRHFMAIFKGKLVIFEGGTSRKGNAEPDPPVRLFQIHGNDKSNTKAVEVPAFASSLNSNDVFLLRTQAEHYLWYGKGSSGDERAMAKELASLLCDGSENTVAEGQEPAEFWDLLGGKTPYANDKRLPQGPKSGRV

SEQ ID NO: 806414 - protein, 285 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVCCRGWRRMATQGSY

SEQ ID NO: 806415 - protein, 900 aa, Homo sapiens
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 806416 - protein, 291 aa, Homo sapiens
VPGQWPNTELHFPACSRRPLNSEAGGRFRLHQRGIHGEMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELVPYLRRRSHEVTAGKGPKFDHDANKTVA

SEQ ID NO: 806417 - protein, 914 aa, Homo sapiens; identical to SEQ ID NO: 806392

SEQ ID NO: 806418 - protein, 610 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATGKYPGRLLMGCS

SEQ ID NO: 806419 - protein, 608 aa, Homo sapiens
MSPTLGTSLVVCSVPMSLPDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 806420 - protein, 571 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVSSSWLGCAWGG

SEQ ID NO: 806421 - protein, 914 aa, Homo sapiens; identical to SEQ ID NO: 806392

SEQ ID NO: 806422 - protein, 914 aa, Homo sapiens; identical to SEQ ID NO: 806392

SEQ ID NO: 806423 - protein, 914 aa, Homo sapiens; identical to SEQ ID NO: 806392

SEQ ID NO: 806424 - protein, 945 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPTLHFQEVKHRYPHFHLKTGPLAGPHTRLPAPSWTVSR

SEQ ID NO: 806425 - protein, 776 aa, Homo sapiens; identical to SEQ ID NO: 806400

SEQ ID NO: 806426 - protein, 882 aa, Homo sapiens; identical to SEQ ID NO: 806397

SEQ ID NO: 806427 - protein, 835 aa, Homo sapiens; identical to SEQ ID NO: 806399

SEQ ID NO: 806428 - protein, 835 aa, Homo sapiens; identical to SEQ ID NO: 806399

SEQ ID NO: 806429 - protein, 734 aa, Homo sapiens; identical to SEQ ID NO: 806402

SEQ ID NO: 806430 - protein, 604 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLGETLGSKETVGCS

SEQ ID NO: 806431 - protein, 1286 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSFNRGDVFLLDLGKVIIQWNGPESNSGERLKAMLLAKDIRDRERGGRAEIGVIEGDKEAASPELMKVLQDTLGRRSIIKPTVPDEIIDQKQKSTIMLYHISDSAGQLAVTEVATRPLVQDLLNHDDCYILDQSGTKIYVWKGKGATKAEKQAAMSKALGFIKMKSYPSSTNVETVNDGAESAMFKQLFQKWSVKDQTMGLGKTFSIGKIAKVFQDKFDVTLLHTKPEVAAQERMVDDGNGKVEVWRIENLELVPVEYQWYGFFYGGDCYLVLYTYEVNGKPHHILYIWQGRHASQDELAASAYQAVEVDRQFDGAAVQVRVRMGTEPRHFMAIFKGKLVIFEGGTSRKGNAEPDPPVRLFQIHGNDKSNTKAVEVPAFASSLNSNDVFLLRTQAEHYLWYGKGSSGDERAMAKELASLLCDGSENTVAEGQEPAEFWDLLGGKTPYANDKRYGNTASPSSGLPLPARLVNCTKAKTSVLKTFLSSLMPLNGLYCRLQQEILDVQSRLFECSNKTGQFVVTEITDFTQDDLNPTDVMLLDTWDQVFLWIGAEANATEKESALATAQQYLHTHPSGRDPDTPILIIKQGFEPPIFTGWFLAWDPNIWSAGKTYEQLKEELGDAAAIMRITADMKNATLSLNSNDSEPKYYPIAVLLKNQNQELPEDVNPAKKENYLSEQDFVSVFGITRGQFAALPGWKQLQMKKEKGLF

SEQ ID NO: 806432 - protein, 1010 aa, Homo sapiens; identical to SEQ ID NO: 806411

SEQ ID NO: 806433 - protein, 385 aa, Homo sapiens
MIRRAGVISFTRRAMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKYCGATAM

SEQ ID NO: 806434 - protein, 133 aa, Homo sapiens
KEAGTNPEGRTIPWGDPKWPPTLKRSRLLSCAGGPETSTAKGKHTTPCPSAPLPKACVSSRFPYPLQGPVAPATKVAMLTPEALRLRQNWGWGREKARWWRSGGNGLSDGHPVLERGCVLLTCLPADRPNDEA

SEQ ID NO: 806435 - protein, 836 aa, Homo sapiens [sequence omitted]

SEQ ID NO: 806436 - protein, 836 aa, Homo sapiens [sequence omitted]

SEQ ID NO: 806437 - protein, 836 aa, Homo sapiens [sequence omitted]

SEQ ID NO: 806438 - protein, 452 aa, Homo sapiens
MQTPNLRLTGELGRVHFWSPLCMASMPHFFQGCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFRQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNGNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 806439 - protein, 487 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISTPLNQCICPWPWIALLSPPCLSGVPWVGCKSYQKGPSGRARWLTPVIPALWEAKAGGSLEVRSSRPAWPTW

SEQ ID NO: 806440 - protein, 836 aa, Homo sapiens [sequence omitted]

SEQ ID NO: 806441 - protein, 836 aa, Homo sapiens [sequence omitted]

SEQ ID NO: 806442 - protein, 836 aa, Homo sapiens [sequence omitted]

SEQ ID NO: 806443 - protein, 836 aa, Homo sapiens [sequence omitted]

SEQ ID NO: 806444 - protein, 716 aa, Homo sapiens
MSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVHLRFMRIVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEECTENPNWALLMFSGDRAQRLKIKEESEAFSEALKEETEFHSTLYHMVKDFASEEAMEKVRSSNCQFVNSVCHMLLSTRLLSYS

SEQ ID NO: 806445 - protein, 676 aa, Homo sapiens
MERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVHLRFMRIVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEECTENPNWALLMFSGDRAQRLKIKEESEAFSEALKEETEFHSTLYHMVKDFASEEAMEKVRSSNCQFVNSVCHMLLSTRLLSYS

SEQ ID NO: 806446 - protein, 774 aa, Homo sapiens
MSGSKKKKVTKAERLKLLQEEEERRLKEEVTVLKKGELTLFSYLPCNKDCDFYKRFHHYILKILGVILRAEKYSDLFTEKKIIFGSLEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVHLRFMENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEECTENPNWALLMFSGDRAQRLKIKEESEAFSEALKEETEFHSTLYHMVKDFASEEAMEKVRSSNCQFVNSVCHMLLSTRLLSYS

SEQ ID NO: 806447 - protein, 444 aa, Homo sapiens
MSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVHLRFMRM

SEQ ID NO: 806448 - protein, 257 aa, Homo sapiens
MSGSKKKKVTKAERLKLLQEEEERRLKEEVTVLKKGELTLFSYLPCNKDCDFYKRFHHYILKILGVILRAEKYSDLFTEKKIIFGSLEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKVSVIFCLYIK

SEQ ID NO: 806449 - protein, 676 aa, Homo sapiens; identical to SEQ ID NO: 806445

SEQ ID NO: 806450 - protein, 604 aa, Homo sapiens
MNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVHLRFMRIVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEECTENPNWALLMFSGDRAQRLKIKEESEAFSEALKEETEFHSTLYHMVKDFASEEAMEKVRSSNCQFVNSVCHMLLSTRLLSYS

SEQ ID NO: 806451 - protein, 169 aa, Homo sapiens
MERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKVNIGELMASAMYPTNQKKDL

SEQ ID NO: 806452 - protein, 104 aa, Homo sapiens
MSPVRDHLSFEQELTPSTPWWRTKKAQLVVTAHVDPIELVVFLPALCHKMGVPYCIIKGKGRLGCLVHRKTKLVEAIRTNYNDRYDEIHRHWGGNVLAPKSVAR

SEQ ID NO: 806453 - protein, 557 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806454 - protein, 480 aa, Homo sapiens
MSLLMSISPGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806455 - protein, 472 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTCACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806456 - protein, 410 aa, Homo sapiens
GSAAAGRRRVGLEPVTMPRRKQSHPQPVKCEGVKVDTEDSLDEGPGALVLESDLLLGQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806457 - protein, 361 aa, Homo sapiens
PFLSGPAAPPCSGRPWAAPGLARRQGRPFMEPPACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806458 - protein, 345 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEDTQW

SEQ ID NO: 806459 - protein, 163 aa, Homo sapiens
MKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806460 - protein, 557 aa, Homo sapiens; identical to SEQ ID NO: 806453

SEQ ID NO: 806461 - protein, 449 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEYTDGPEATFFSPAGQGLHTD

SEQ ID NO: 806462 - protein, 335 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDFIQTDQKPPFSPPLARGSTQTNVGTIRTSPTPWAGGPIWTRGPCLD

SEQ ID NO: 806463 - protein, 166 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGVYRRTRSHLFLPRWPGAPHRLT

SEQ ID NO: 806464 - protein, 479 aa, Homo sapiens
MGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806465 - protein, 411 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806466 - protein, 287 aa, Homo sapiens
MEVMWRCPELTEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 806467 - protein, 557 aa, Homo sapiens; identical to SEQ ID NO: 806453

SEQ ID NO: 806468 - protein, 530 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHYTDGPEATFFSPAGQGLHTD

SEQ ID NO: 806469 - protein, 499 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRRRRRERPELGAGARAGGCPGPAPLHGGGPRALRGRADRRAEIGGAGSGGR

SEQ ID NO: 806470 - protein, 93 aa, Homo sapiens
GSAAAGRRRVGLEPVTMPRRKQSHPQPVKCEGVKVDTEDSLDEGPGALVLESDLLLGQDLEFEEEEEEEEGDGNSDQLMGFERDSEGGFSGLG

SEQ ID NO: 806471 - protein, 94 aa, Homo sapiens
QQQLGSLLSYTSGHWSNPTQNPSFPLACRTTGTVMMVTSAAAPSSPRRTFHGVCKPSRSSPIRGKRVAPVSVGGSGLLQRQQDLQEGRLYTENK

SEQ ID NO: 806472 - protein, 160 aa, Homo sapiens
MQKPKIKKSVSHERVSKMNFKLTGKGITFFSSESKKYERPKDDREEEFNTWVNNMYVFFVNTLFHAYKREEAIKEKIRADRLRSTAQAQQRKMEDDELEARLNIFILREEEAKRHDYEVDITVLKEPADVSSSHLILDPPKEDVTVSPSSKTITSKKKKK

SEQ ID NO: 806473 - protein, 229 aa, Homo sapiens
LKPIDYVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGKHTQIWYYCRGLFKSKASDTCLDVIGGRDTPGAKVALWTEHGQFRQKWRLNKNGTISSYLSDQLVLDVKGGNYCDKTHVIVNQPLEGEETQKWDIEIL

SEQ ID NO: 806474 - protein, 300 aa, Homo sapiens
MAEPTVCSFLTKVLCAHGGRMFLKDLRGHVELSEARLRDVLQRAGPERFLLQEVETQEGLGDAEAEAAAGAVGGGGTSAWRVVAVSSVRLCARYQRGECQACDQLHFCRRHMLGKCPNRDCWSTCTLSHDIHTPVNMQVLKSHGLFGLNENQLRILLLQNDPCLLPEVCLLYNKGEALYGYCNLKDKCNKFHVCKSFVKGECKLQTCKRSHQLIHAASLKLLQDQGLNIPSVVNFQIISTYKHMKLHKMLENTDNSSPSTEHSQGLEKQGVHAAGAAEAGPLASVPAQSAKKPCPVSCEK

SEQ ID NO: 806475 - protein, 163 aa, Homo sapiens
MPQAPYPASTRRGRPSPGLPQAHPSPGPGPSPGCSLEIVDVTGRSLPAPARCAARTGPAPATMAEPTVCSFLTKVLCAHGGRMFLKDLRGHVELSEARLRDVLQRAGPERFLLQEVETQEGLGDAEAEAAAGAVGGGGTSAWRVVAVSTIGACHHTQLIFLGF

SEQ ID NO: 806476 - protein, 96 aa, Homo sapiens
AKKKRKTNISGVPSFLYQVCLLYNKGEALYGYCNLKDKCNKFHVCKSFVKGECKLQTCKRSHQLIHAASLKLLQDQGLNIPSVVNFQIISTYKHMK

SEQ ID NO: 806477 - protein, 107 aa, Homo sapiens
DRPSVWRAGPDEVSEHGAIDVPEEILVLTSAMDSRANIKAVRRNARRSDNCCTREFRGSLTIGSVAYQDVLQAMLDDAKVISPGLGHCTQPDVPSFISAIPSSYLTT

SEQ ID NO: 806478 - protein, 219 aa, Homo sapiens
MEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 806479 - protein, 219 aa, Homo sapiens; identical to SEQ ID NO: 806478

SEQ ID NO: 806480 - protein, 219 aa, Homo sapiens; identical to SEQ ID NO: 806478

SEQ ID NO: 806481 - protein, 219 aa, Homo sapiens; identical to SEQ ID NO: 806478

SEQ ID NO: 806482 - protein, 219 aa, Homo sapiens; identical to SEQ ID NO: 806478

SEQ ID NO: 806483 - protein, 117 aa, Homo sapiens
MPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 806484 - protein, 219 aa, Homo sapiens; identical to SEQ ID NO: 806478

SEQ ID NO: 806485 - protein, 219 aa, Homo sapiens; identical to SEQ ID NO: 806478

SEQ ID NO: 806486 - protein, 219 aa, Homo sapiens; identical to SEQ ID NO: 806478

SEQ ID NO: 806487 - protein, 219 aa, Homo sapiens; identical to SEQ ID NO: 806478

SEQ ID NO: 806488 - protein, 219 aa, Homo sapiens; identical to SEQ ID NO: 806478

SEQ ID NO: 806489 - protein, 219 aa, Homo sapiens; identical to SEQ ID NO: 806478

SEQ ID NO: 806490 - protein, 219 aa, Homo sapiens; identical to SEQ ID NO: 806478

SEQ ID NO: 806491 - protein, 219 aa, Homo sapiens; identical to SEQ ID NO: 806478

SEQ ID NO: 806492 - protein, 254 aa, Homo sapiens
MAVTLSLLLGGRVCAAVTRCGFATRGVAGPGPIGREPDPDSDWEPEERELQEVERYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 806493 - protein, 104 aa, Homo sapiens
PERNLQKILLTKPPAGVSNLKNEAYYTSRYEGWVALVCVDMAVTLSLLLGGRVCAAVTRCGFATRGVAGPGPIGREPDPDSDWEPEERELQEVERYRLLPGPSA

SEQ ID NO: 806494 - protein, 207 aa, Homo sapiens
MEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPLQYSLFLLRLSVC

SEQ ID NO: 806495 - protein, 211 aa, Homo sapiens
MEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPFFISSLPSPWCICPVSV

SEQ ID NO: 806496 - protein, 191 aa, Homo sapiens
MEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQNQTSCGSAPSLTSVDLQYSLFLLRLSVC

SEQ ID NO: 806497 - protein, 146 aa, Homo sapiens
MEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKEGSGGYQRVR

SEQ ID NO: 806498 - protein, 114 aa, Homo sapiens
FSMHIALQPGQHERNSISNRKRKSERERELPGRNKEIQDLEESFVPVAAPLGHPRELQKYSSDSESPRGTGSGALPSGQKLEELKAEEPDNFSSKVVQRGREFFDSNGNFLYRI

SEQ ID NO: 806499 - protein, 68 aa, Homo sapiens
NRLVEAACYSVRGYSSDSESPRGTGSGALPSGQKLEELKAEEPDNFSSKVVQRGREFFDSNGNFLYRI

SEQ ID NO: 806500 - protein, 112 aa, Homo sapiens
MEAPGAPPRTLTWEAMEQIRYLHEEFPESWSVPRLAEGFDVSTDVIRRVLKSKFLPTLEQKLKQDQKVLKKAGLAHSLQPTWELTRTLEIPHVNTVCSMASHVRSWQLFSQS

SEQ ID NO: 806501 - protein, 148 aa, Homo sapiens
MEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIEDNFSSKVVQRGREFFDSNGNFLYRI

SEQ ID NO: 806502 - protein, 104 aa, Homo sapiens; identical to SEQ ID NO: 806493

SEQ ID NO: 806503 - protein, 207 aa, Homo sapiens; identical to SEQ ID NO: 806494

SEQ ID NO: 806504 - protein, 71 aa, Homo sapiens
SMELQEFTRSLPRLAEGFDVSTDVIRRVLKSKFLPTLEQKLKQDQPPGLWKYLKAAPCRPLCIRLFAYARA

SEQ ID NO: 806505 - protein, 219 aa, Homo sapiens; identical to SEQ ID NO: 806478

SEQ ID NO: 806506 - protein, 219 aa, Homo sapiens; identical to SEQ ID NO: 806478

SEQ ID NO: 806507 - protein, 219 aa, Homo sapiens; identical to SEQ ID NO: 806478

SEQ ID NO: 806508 - protein, 148 aa, Homo sapiens; identical to SEQ ID NO: 806501

SEQ ID NO: 806509 - protein, 117 aa, Homo sapiens; identical to SEQ ID NO: 806483

SEQ ID NO: 806510 - protein, 117 aa, Homo sapiens; identical to SEQ ID NO: 806483

SEQ ID NO: 806511 - protein, 471 aa, Homo sapiens
MAKKVAVIGAGVSGLISLKCCVDEGLEPTCFERTEDIGGVWRFKENVEDGRASIYQSVVTNTSKEMSCFSDFPMPEDFPNFLHNSKLLEYFRIFAKKFDLLKYIQFQTTVLSVRKCPDFSSSGQWKVVTQSNGKEQSAVFDAVMVCSGHHILPHIPLKSFPGMERFKGQYFHSRQYKHPDGFEGKRILVIGMGNSGSDIAVELSKNAAQVFISTRHGTWVMSRISEDGYPWDSVFHTRFRSMLRNVLPRTAVKWMIEQQMNRWFNHENYGLEPQNKYIMKEPVLNDDVPSRLLCGAIKVKSTVKELTETSAIFEDGTVEENIDVIIFATGYSFSFPFLEDSLVKVENNMVSLYKYIFPAHLDKSTLACIGLIQPLGSIFPTAELQARWVTRVFKGLCSLPSERTMMMDIIKRNEKRIDLFGESQSQTLQTNYVDYLDELALEIGAKPDFCSLLFKDPKLAVRLYFGPCNSY

SEQ ID NO: 806512 - protein, 185 aa, Homo sapiens
MAKKVAVIGAGVSGLISLKCCVDEGLEPTCFERTEDIGGVWRFKENVEDGRASIYQSVVTNTSKEMSCFSDFPMPEDFPNFLHNSKLLEYFRIFAKKFDLLKYIQFQTTVLSVRKCPDFSSSGQWKVVTQSNGKEQSAVFDAVMVCSGHHILPHIPLKSFPGMERFKGQYFHSRQYKHPDGFEGA

SEQ ID NO: 806513 - protein, 308 aa, Homo sapiens
MSIIIVLSEGRLHKPLKTLVTNELEVQQLGKWNLGAGGDQCTRGLTCPGERGICIYTVSRISEDGYPWDSVFHTRFRSMLRNVLPRTAVKWMIEQQMNRWFNHENYGLEPQNKYIMKEPVLNDDVPSRLLCGAIKVKSTVKELTETSAIFEDGTVEENIDVIIFATGYSFSFPFLEDSLVKVENNMVSLYKYIFPAHLDKSTLACIGLIQPLGSIFPTAELQARWVTRVFKGLCSLPSERTMMMDIIKRNEKRIDLFGESQSQTLQTNYVDYLDELALEIGAKPDFCSLLFKDPKLAVRLYFGPCNSY

SEQ ID NO: 806514 - protein, 308 aa, Homo sapiens
RGEAAWAGPGRAGGARSASWMSRLRALLGLGLLVAGSRLPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 806515 - protein, 308 aa, Homo sapiens; identical to SEQ ID NO: 806514

SEQ ID NO: 806516 - protein, 310 aa, Homo sapiens
FVLASRLVCIRATYGGARSASWMSRLRALLGLGLLVAGSRLPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 806517 - protein, 174 aa, Homo sapiens
ALEKKYQLNLPPYPDTIKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 806518 - protein, 282 aa, Homo sapiens
FVLASRLVCIRATYGGARSASWMSRLRALLGLGLLVAGSRLPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAELQGRCSGTVPQHPECPEGTHCAHCQHRHSLRMGRGEGKCWRDPARLAHLPHSPQKICNPVYRSLPLPGGSFCATCSGKEVPAEPATLP

SEQ ID NO: 806519 - protein, 259 aa, Homo sapiens
FVLASRLVCIRATYGGARSASWMSRLRALLGLGLLVAGSRLPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDPEGGVGEIGALPS

SEQ ID NO: 806520 - protein, 199 aa, Homo sapiens
FVLASRLVCIRATYGGARSASWMSRLRALLGLGLLVAGSRLPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEVGGSS

SEQ ID NO: 806521 - protein, 115 aa, Homo sapiens
MTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 806522 - protein, 286 aa, Homo sapiens
RGEAAWAGPGRAGGARSASWMSRLRALLGLGLLVAGSRLPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLSANSGGIL

SEQ ID NO: 806523 - protein, 265 aa, Homo sapiens
FVLASRLVCIRATYGGARSASWMSRLRALLGLGLLVAGSRLPRIKSQTIACRSGPTWWGPQRLNSGGRWDSEVMASTVVKYLSQEEAQAVDQELFNEYQFSVDQLMELAGLSCATAIAKPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 806524 - protein, 259 aa, Homo sapiens; identical to SEQ ID NO: 806519

SEQ ID NO: 806525 - protein, 49 aa, Homo sapiens
MSRSPPTVLVICGPGNNGGDGLVCARHLKLFVSMWGGAVGEEGVRALGS

SEQ ID NO: 806526 - protein, 271 aa, Homo sapiens
MGSAGLSRLHGLFAVYKPPGLKWKHLRDTVELQLLKGLNARKPPAPKQRVRFLLGPMEGSEEKELTLTATSVPSFINHPLVCGPAFAHLKVGVGHRLDAQASGVLVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEGAAWWDTDKGAEWARKRRGKRPGCGPPGGHPRVYPKGPLAGAPTHGS

SEQ ID NO: 806527 - protein, 331 aa, Homo sapiens
MGSAGLSRLHGLFAVYKPPGLKWKHLRDTVELQLLKGLNARKPPAPKQRVRFLLGPMEGSEEKELTLTATSVPSFINHPLVCGPAFAHLKVGVGHRLDAQASGVLVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEVQCMHETQKELRKLVHEIGLELKTTAVCTQVRRTRDGFFTLDSALLRTQWDLTNIQDAIRAATPQVAAELEKSLSPGLDTKQLPSPGWSWDSQGPSSTLGLERGAGQ

SEQ ID NO: 806528 - protein, 306 aa, Homo sapiens
MGSAGLSRLHGLFAVYKPPGLKWKHLRDTVELQLLKGLNARKPPAPKQRVRFLLGPMEGSEEKELTLTATSVPSFINHPLVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEVQCMHETQKELRKLVHEIGLELKTTAVCTQVRRTRDGFFTLDSALLRTQWDLTNIQDAIRAATPQVAAELEKSLSPGLDTKQLPSPGWSWDSQGPSSTLGLERGAGQ

SEQ ID NO: 806529 - protein, 140 aa, Homo sapiens [sequence omitted]

SEQ ID NO: 806530 - protein, 331 aa, Homo sapiens; identical to SEQ ID NO: 806527

SEQ ID NO: 806531 - protein, 131 aa, Homo sapiens
AFRGETSLHGQKACRPSRRRKRTRTVYRLRPPIQDSRHVTSPQKVSAKDTQPRSLSAGPYFLLHSRFSPKTIKCEPLPAVEHGGARGKDHIWGRGLAVLPSRSSGCCDLQVWGLLACRGCMGFSRSISPRG

SEQ ID NO: 806532 - protein, 426 aa, Homo sapiens
AFRGETSLHGQKACRPSRRRKRTRTVYRLRPPIQDSRHVTSPQKVSAKDTQPRSLSAGPYFLLHSRFSPKTIKCEPLPAVEHGGARGKDHIWGRGLAVLPSRSSGCCDLQVWGLLACRGCMGFSRSISPRGCLNARKPPAPKQRVRFLLGPMEGSEEKELTLTATSVPSFINHPLVCGPAFAHLKVGVGHRLDAQASGVLVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEVQCMHETQKELRKLVHEIGLELKTTAVCTQVRRTRDGFFTLDSALLRTQWDLTNIQDAIRAATPQVAAELEKSLSPGLDTKQLPSPGWSWDSQGPSSTLGLERGAGQ

SEQ ID NO: 806533 - protein, 287 aa, Homo sapiens
MGSAGLSRLHGLFAVYKPPGLKWKHLRDTVELQLLKVCGPAFAHLKVGVGHRLDAQASGVLVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEVQCMHETQKELRKLVHEIGLELKTTAVCTQVRRTRDGFFTLDSALLRTQWDLTNIQDAIRAATPQVAAELEKSLSPGLDTKQLPSPGWSWDSQGPSSTLGLERGAGQ

SEQ ID NO: 806534 - protein, 356 aa, Homo sapiens
MGSAGLSRLHGLFAVYKPPGLKWKHLRDTVELQLLKGLNARKPPAPKQRVRFLLGPMEGSEEKELTLTATSVPSFINHPLVCGPAFAHLKVGVGHRLDAQASGVLGVRILWRAWQGSKAPSNHESDSVHMVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEVQCMHETQKELRKLVHEIGLELKTTAVCTQVRRTRDGFFTLDSALLRTQWDLTNIQDAIRAATPQVAAELEKSLSPGLDTKQLPSPGWSWDSQGPSSTLGLERGAGQ

SEQ ID NO: 806535 - protein, 118 aa, Homo sapiens [sequence omitted]

SEQ ID NO: 806536 - protein, 467 aa, Homo sapiens
RATAAAAARAGPGAPRAAATLAGAAVKLDPQAGVRGAGAAAAPQRCDSGRRPAGASALRGRGGRMFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 806537 - protein, 467 aa, Homo sapiens; identical to SEQ ID NO: 806536

SEQ ID NO: 806538 - protein, 467 aa, Homo sapiens; identical to SEQ ID NO: 806536

SEQ ID NO: 806539 - protein, 403 aa, Homo sapiens
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 806540 - protein, 467 aa, Homo sapiens; identical to SEQ ID NO: 806536

SEQ ID NO: 806541 - protein, 365 aa, Homo sapiens
TRPLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERGALYQGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 806542 - protein, 129 aa, Homo sapiens
RATAAAAARAGPGAPRAAATLAGAAVKLDPQAGVRGAGAAAAPQRCDSGRRPAGASALRGRGGRMFVASERKMRAHQVLTFLLLFVITSVASEHAQLLRHVAAQDAGDGLRGGRAAAAGLYGEQGLLHG

SEQ ID NO: 806543 - protein, 106 aa, Homo sapiens
LRQACKETLEGSLSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 806544 - protein, 467 aa, Homo sapiens; identical to SEQ ID NO: 806536

SEQ ID NO: 806545 - protein, 467 aa, Homo sapiens; identical to SEQ ID NO: 806536

SEQ ID NO: 806546 - protein, 403 aa, Homo sapiens; identical to SEQ ID NO: 806539

SEQ ID NO: 806547 - protein, 1181 aa, Homo sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVVRRPGLYPNGLGAPVCCRKHRSLGRLERPLSQPGRHALPHVTGGLACVHRDHSPPSAKRSDGLHRASLRASETCIALDHCLLLYKWQKSDKIHSDRTCQRQGMKKVLWAMATPDAFLVGLLGAVCCPERPADPVWEQAQWELPQCPLLAALRRGPLDRQCGVGSGSASGRQPLDFVTTVALKMAPTSPVVNIKVTLPLAGSSPGALEPEALRRRAWKEVELFTVSFHLGSAAQLCGRRPDPTPSVPLPALLCMAPSGRSSGVGPRPQMLCWGLGTELPPVSPLWSPGLLPPVELPLGLPPAPFDAIKGCFIAGGVAETTILGCIYLLKVHSLHHRHYCSSVPSGRMHTSRPLLSSSRGWGPFLAPFCLTDPVACSWAVVLLPDTGPLTFLRFGDEAGSVRFLAHPYLFYVEVSGSFLCMFVSLCVYVAKRLQVRVAHETSRVTGGPLFQGHRCILGCAEAVLSRSVFPDQRGSTWEACLKHAVLWCCSGMDSMHSPLLDTFSHCGWRPIFSIPCGMRILSCPQTDLTFVPELSRAVSFVTELPVPELGLLELMLEAVCGQACAPLGEGLLLNKEVLATRVPYWLQRTKQEACRGSHMHWGRAARFQSSRHVHYGCQVASEGPRTTQQSPPRA

SEQ ID NO: 806548 - protein, 109 aa, Homo sapiens
NPLPPRPSRGMVRLLQRWGGSFPDCFSCHNKISQTGWIKQQKFISHSSGGWEVQDQGVSKVKTLTVRKGKPQVQDKVVKSRRNSGCVVLVQGSLPPAWGHTGWLCSHDT

SEQ ID NO: 806549 - protein, 339 aa, Homo sapiens
IKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEKERKKTELALAKNYPGKKVSSTNNTPVPRLTSNPSRVDRLIVDELRELARVVTLLGKMERLRSSLLHASISTALDRHLESIHIVQSRRKDEIVNASNRQRQGVPRCQDDRDVFALASAIKEMCVATRKTRTALWCALQMTLPKTASTADVH

SEQ ID NO: 806550 - protein, 371 aa, Homo sapiens
IKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEKERKKTELALAKNYPGKKVSSTNNTPVPRLTSNPSRVDRLIVDELRELARVVTLLGKMERLRSSLLHASISTALDRHLESIHIVQSRRKDEIVNASNRQRQGVPRCQDDRDVFALASAIKEMCVATRKTRTALWCALQMTLPKTASTADVVKPLQDTVNCEDKVHESINSSNPMNQRGETNKH

SEQ ID NO: 806551 - protein, 68 aa, Homo sapiens
MWIFSRNFIPMLMADIRKEERNHLCRSSRRTWTILDRAEYSDHVVLQGAGVGWGTSRSPWRKVRNQEC

SEQ ID NO: 806552 - protein, 99 aa, Homo sapiens
MRNSRDIQNKLLRCVVICLKSDGKREIIKFNFIIHRAANHWCSGRICYTTLGRILWYNVSLKTLKYGNGLCMFSLHIILFSCLPPFCFFLFSFVLRVPA

SEQ ID NO: 806553 - protein, 366 aa, Homo sapiens
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQLTSEMFEADLEKALLLSKLEYEEHKKEYEDAENTSTQSKVMNKKDKRKNHQGKDRPLTVSLKDFHSEDHISKKTEELSSSQTLSHDGGFFNRLEDDVHKILIREKRREQLTEYNGTDNCTAHEHNQEVVLKDGRIERLKLELERKDAEIQKLKNVITQWEAKYKEVKARNAQLLKMLQEGEMKDKAEILLQVDESQSIKNELTIQVTSLHAALEQERSKVKVLQAELAKYQGGRKGKRNSESDQCR

SEQ ID NO: 806554 - protein, 203 aa, Homo sapiens
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQLTSEMFEADLEKALLLSKLEYEEHKKEYEDAENTSTQSKVMNKKDKRKNHQGKDRPLTVSLKDFHSEDHISKKTGSGSERWKN

SEQ ID NO: 806555 - protein, 135 aa, Homo sapiens
SYLFCFFPTIQPSFSEVVLKDGRIERLKLELERKDAEIQKLKNVITQWEAKYKEVKARNAQLLKMLQEGEMKDKAEILLQVDESQSIKNELTIQVTSLHAALEQERSKVKVLQAELAKYQGGRKGKRNSESDQCR

SEQ ID NO: 806556 - protein, 366 aa, Homo sapiens; identical to SEQ ID NO: 806553

SEQ ID NO: 806557 - protein, 366 aa, Homo sapiens; identical to SEQ ID NO: 806553

SEQ ID NO: 806558 - protein, 366 aa, Homo sapiens; identical to SEQ ID NO: 806553

SEQ ID NO: 806559 - protein, 366 aa, Homo sapiens; identical to SEQ ID NO: 806553

SEQ ID NO: 806560 - protein, 388 aa, Homo sapiens
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQMGSRRQCGSQEEGDLKYSILDTLTSEMFEADLEKALLLSKLEYEEHKKEYEDAENTSTQSKVMNKKDKRKNHQGKDRPLTVSLKDFHSEDHISKKTEELSSSQTLSHDGGFFNRLEDDVHKILIREKRREQLTEYNGTDNCTAHEHNQEVVLKDGRIERLKLELERKDAEIQKLKNVITQWEAKYKEVKARNAQLLKMLQEGEMKDKAEILLQVDESQSIKNELTIQVTSLHAALEQERSKVKVLQAELAKYQGGRKGKRNSESDQCR

SEQ ID NO: 806561 - protein, 366 aa, Homo sapiens; identical to SEQ ID NO: 806553

SEQ ID NO: 806562 - protein, 366 aa, Homo sapiens; identical to SEQ ID NO: 806553

SEQ ID NO: 806563 - protein, 328 aa, Homo sapiens
MPGSLKRDHILYHLILIWGIIFISHQDKIPGGGITCKVHTSPPMYSLDRIFAGFRTQSQMLLDHVEERDEVLHCQFSDNSDDEESEGQEKSGTRCKKSFMDSEARLCSLVELSDTQDETQKSDSENEDLKIDCLQESQELNLQKLKNSERILTEAKQKMRELTVNIKMKEDLIKELIKTGNDAKSVSKQYTLKVTKLEHDAEQAKVELTETQKQLQELENKDLSDVAMKVKLQKEFRKKVDAAKLRVQVLQKKQQDSKKLASLSIQNEKRANELEQSVDHMKYQKIQLQRKLQEENEKRKQLDAVIKRDQQKIKVILSYIPAKYNMKC

SEQ ID NO: 806564 - protein, 343 aa, Homo sapiens
MPGSLKRDHILYHLILIWGIIFISHQDKIPGGGITCKVHTSPPMYSLDRIFAGFRTQSQMLLDHVEERDEVLHCQFSDNSDDEESEGQEKSGTRCKKSFMDSEARLCSLVELSDTQDETQKSDSENEDLKIDCLQESQELNLQKLKNSERILTEAKQKMRELTVNIKMKEDLIKELIKTGNDAKSVSKQYTLKVTKLEHDAEQAKVELTETQKQLQELENKDLSDVAMKVKLQKEFRKKVDAAKLRVQVLQKKQQDSKKLASLSIQNEKRANELEQSVDHMKYQKIQLQRKLQEENEKRKQLDAVIKRDQQKIKQKECFQLLHLRESWPSTVAHACNRSTLGG

SEQ ID NO: 806565 - protein, 117 aa, Homo sapiens
REALTPPPPPGLPSTLRPPACSQPRSPRPSPQPAAALTSAVRPGAPGPVSAQPAGRPRPPPGASLPPALPTLDPDQSQRPVRPPGEPRERRRRGEEGEEGRAGGTGGPVLKPLLCPS

SEQ ID NO: 806566 - protein, 117 aa, Homo sapiens; identical to SEQ ID NO: 806565

SEQ ID NO: 806567 - protein, 441 aa, Homo sapiens
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTDTFRGFCDHKLHDVLIAPGTADLTADVDFSYLRRMAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 806568 - protein, 132 aa, Homo sapiens
MKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTDTFRVCIIQ

SEQ ID NO: 806569 - protein, 112 aa, Homo sapiens
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGECGCVGSTCVRSGT

SEQ ID NO: 806570 - protein, 441 aa, Homo sapiens; identical to SEQ ID NO: 806567

SEQ ID NO: 806571 - protein, 441 aa, Homo sapiens; identical to SEQ ID NO: 806567

SEQ ID NO: 806572 - protein, 196 aa, Homo sapiens
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEGTAFILHMNFLMFFLCINFRKHHRDGEKYLLTLIHRFLIN

SEQ ID NO: 806573 - protein, 441 aa, Homo sapiens; identical to SEQ ID NO: 806567

SEQ ID NO: 806574 - protein, 441 aa, Homo sapiens; identical to SEQ ID NO: 806567

SEQ ID NO: 806575 - protein, 317 aa, Homo sapiens
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTDTFRVCIIQ

SEQ ID NO: 806576 - protein, 399 aa, Homo sapiens
MLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTDTFRGFCDHKLHDVLIAPGTADLTADVDFSYLRRMAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 806577 - protein, 172 aa, Homo sapiens [sequence omitted]

SEQ ID NO: 806578 - protein, 370 aa, Homo sapiens
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEKTPQGWREVFVDIDPQVSDKLRFVLAPSATPAEAFIQHDETRDHVEVCPDAGVIIEELSQRIALTGGAALVADYGHDGTKTDTFRGFCDHKLHDVLIAPGTADLTADVDFSYLRRMAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 806579 - protein, 172 aa, Homo sapiens [sequence omitted]

SEQ ID NO: 806580 - protein, 172 aa, Homo sapiens [sequence omitted]

SEQ ID NO: 806581 - protein, 273 aa, Homo sapiens
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEKTPQGWREVFVDIDPQVSDKLRFVLAPSATPAEAFIQHEESSRDGCGADSSKKEDLLSVAYKECDVELEEPPGEYQQLVLHQAGGPAPSTVCSSEEKKCKQERRIEESDDDMGGLCD

SEQ ID NO: 806582 - protein, 374 aa, Homo sapiens
MAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 806583 - protein, 374 aa, Homo sapiens; identical to SEQ ID NO: 806582

SEQ ID NO: 806584 - protein, 288 aa, Homo sapiens
MLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 806585 - protein, 374 aa, Homo sapiens; identical to SEQ ID NO: 806582

SEQ ID NO: 806586 - protein, 374 aa, Homo sapiens; identical to SEQ ID NO: 806582

SEQ ID NO: 806587 - protein, 251 aa, Homo sapiens
AASEDPLSLTTLSRRPTISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 806588 - protein, 374 aa, Homo sapiens; identical to SEQ ID NO: 806582

SEQ ID NO: 806589 - protein, 111 aa, Homo sapiens
SIELGPLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 806590 - protein, 250 aa, Homo sapiens
MAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKVSWDFVVLKNVLSFFFLKNFSKIKYFLTCLPFLHSSYLNSYPIILPPTLFPQSLKSLSIS

SEQ ID NO: 806591 - protein, 684 aa, Homo sapiens
ENSTGLCEQNPAKRMAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTGSICASFLTQSYQLPVLDTMFLRKKYRGKDFGLHMLEDFVDSFTEDALGLRYPLSSLMYTACKQYFEKYPGDHELLWEVEGVGHWYQRIPVTRALQREALKILALSQNEPKRPMSGEYGPASVPEYEARTEDNQSSEMQLTIDSLKDAFASTSEGHDKTSVSTHTRSGNLKRPKIGKRFQDSEFSSSQGEDEKTSQTSLTASINKLESTARPSESSEEFLEEEPEQRGIEFEDESSDRDARPALETQPQQEKQDGEKESELEPMNGEIMDDSLKTSLITEEEDSTSEVLDEELKLQPFNSSEDSTNLVPLVVESSKPPEVDAPDKTPRIPDSEMLMDEGTSDEKGHMEEKLSLLPRKKAHLGSSDNVATMSNEERSDGGFPNSVIAEFSEEPVSENLSPNTTSSLEDQGEEGVSEPQETSTALPQSSLIEVELEDVPFSQNAGQKNQSEEQSEASSEQLDQFTQSAEKAVDSSSEEIEVEVPVVDRRNLRRKAKGHKGPAKKKAKLT

SEQ ID NO: 806592 - protein, 348 aa, Homo sapiens
RDEEPGVRGEREAAALALAAASCAAWDRPEVASEQPPAPFIRAAPPPFPGSSSGSRGASERMAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQEAYVPLFLPKVTNCQFLIQMFLRKKYRGKDFGLHMLEDFVDSFTEDALGLRYPLSSLMYTACKQYFEKYPGDHELLWEVEGVGHWYQRIPVTRALQREALKILALSQMNSKTMSGNIGPAVLSRNTKAELEEPGYVEKRVQMRLLKSGVDSRGRLNIVVPIAGGHGPQWYDVGDVIAHGRK

SEQ ID NO: 806593 - protein, 423 aa, Homo sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 806594 - protein, 491 aa, Homo sapiens
MKRPRCPFVSYKQPAAPPSEGTRRGGAARPEEAAEEGPPAAPGSLRHSGPLGPHACPTALPEPQVTSAMSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 806595 - protein, 423 aa, Homo sapiens; identical to SEQ ID NO: 806593

SEQ ID NO: 806596 - protein, 423 aa, Homo sapiens; identical to SEQ ID NO: 806593

SEQ ID NO: 806597 - protein, 423 aa, Homo sapiens; identical to SEQ ID NO: 806593

SEQ ID NO: 806598 - protein, 280 aa, Homo sapiens [sequence omitted]

SEQ ID NO: 806599 - protein, 393 aa, Homo sapiens
MRLGAEMQPRCLVQLLPHPGRAPPPSSHSPPCLLMAPCSPFPPHTPRPVLARGESGLSCQLGPLPAREAATGACLFLAGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 806600 - protein, 127 aa, Homo sapiens
MGALPRGWAGGARGPCASAAGRRAGRAACGVRLWGQSGPRLGPSRGSDWSGFRRDPASESWWAGLGQDLALAAGPDSGQGWASDPARSGAGFNPAFAEVPGAGRGGRRGGLYVWEGALKTTWGRSKG

SEQ ID NO: 806601 - protein, 32 aa, Homo sapiens
MPDPAGPDGHLPAVATLCDLFDREIVVTISWA

SEQ ID NO: 806602 - protein, 434 aa, Homo sapiens
MKRPRCPFVSYKQPAAPPSEGTRRGGAARPEEAAEEGPPAAPGSLRHSGPLGPHACPTALPEPQVTSAMSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 806603 - protein, 212 aa, Homo sapiens
MPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 806604 - protein, 212 aa, Homo sapiens
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 806605 - protein, 212 aa, Homo sapiens; identical to SEQ ID NO: 806604

SEQ ID NO: 806606 - protein, 212 aa, Homo sapiens; identical to SEQ ID NO: 806604

SEQ ID NO: 806607 - protein, 212 aa, Homo sapiens; identical to SEQ ID NO: 806604

SEQ ID NO: 806608 - protein, 212 aa, Homo sapiens; identical to SEQ ID NO: 806604

SEQ ID NO: 806609 - protein, 212 aa, Homo sapiens; identical to SEQ ID NO: 806604

SEQ ID NO: 806610 - protein, 212 aa, Homo sapiens; identical to SEQ ID NO: 806604

SEQ ID NO: 806611 - protein, 534 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 806612 - protein, 534 aa, Homo sapiens; identical to SEQ ID NO: 806611

SEQ ID NO: 806613 - protein, 534 aa, Homo sapiens; identical to SEQ ID NO: 806611

SEQ ID NO: 806614 - protein, 534 aa, Homo sapiens; identical to SEQ ID NO: 806611

SEQ ID NO: 806615 - protein, 534 aa, Homo sapiens; identical to SEQ ID NO: 806611

SEQ ID NO: 806616 - protein, 534 aa, Homo sapiens; identical to SEQ ID NO: 806611

SEQ ID NO: 806617 - protein, 298 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIWVSLC

SEQ ID NO: 806618 - protein, 325 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPIWVSLC

SEQ ID NO: 806619 - protein, 417 aa, Homo sapiens
MSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 806620 - protein, 382 aa, Homo sapiens
RFGSRCARDANALWRLMTYIPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 806621 - protein, 290 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSGSSASRVRY

SEQ ID NO: 806622 - protein, 286 aa, Homo sapiens
YKIIVSPANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 806623 - protein, 285 aa, Homo sapiens
LPQPPKVFGLQALATVPGLKHLYFIKVKSSKFPNPSEVSFAPEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 806624 - protein, 134 aa, Homo sapiens
MTRKQESEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 806625 - protein, 534 aa, Homo sapiens; identical to SEQ ID NO: 806611

SEQ ID NO: 806626 - protein, 411 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQVGCQ

SEQ ID NO: 806627 - protein, 417 aa, Homo sapiens; identical to SEQ ID NO: 806619

SEQ ID NO: 806628 - protein, 467 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKVTQSGPSPHFLHTVKYPSCAHFALSC

SEQ ID NO: 806629 - protein, 421 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQKFSNTPDHAPSRSK

SEQ ID NO: 806630 - protein, 414 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQVTNQGRN

SEQ ID NO: 806631 - protein, 264 aa, Homo sapiens
PTLRDLASDCANHALSPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 806632 - protein, 217 aa, Homo sapiens
MRALTLLTTTRYRSSDPYLLAITSLSKFLISISLCWQMIQFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 806633 - protein, 168 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGREPIGPMLERIQTTFVATGKTTHFCTNACPFG

SEQ ID NO: 806634 - protein, 58 aa, Homo sapiens
MELCAGPQLRGQNGRDIDKESRSLEYFPGKASCSISATQPTKIYQAATTGPLNGPHHG

SEQ ID NO: 806635 - protein, 89 aa, Homo sapiens
HRVKKPRGRRLVEPWIASGGKGWKYDVMDIIMGHCVGTRPPACCLILLLFKLLATVSQGLPGTGPLGFHFTHSIYNATVYENSAARTYV

SEQ ID NO: 806636 - protein, 191 aa, Homo sapiens
HASFLVVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNI

SEQ ID NO: 806637 - protein, 104 aa, Homo sapiens [sequence omitted]

SEQ ID NO: 806638 - protein, 74 aa, Homo sapiens
QVLQALACHGFGGPPQEAVSAAGAAAQQVVDQATEAGQKAMDQLAKTTQETIDKTANQASDTFSGIGKKFGLLK

SEQ ID NO: 806639 - protein, 206 aa, Homo sapiens
MLSKRPLLSLRSTPALSSCPGADPALTPRIRKGGLGLMSWEVVCALLLPPAPLWTPVLAPLRSLVRSAPFPPRPVLGQDVLPALRTLEQGPATPRSLYDGNRPAPSPLRGAGQPWGALKTGAGAWHRHSGQDPTSLQLLLTTPQIPRSHGKQGLAGPEATGGGDRPGSRVSGRSGSSASGGPGHRGGAESHGPAGQDHPGNHRQDC

SEQ ID NO: 806640 - protein, 206 aa, Homo sapiens; identical to SEQ ID NO: 806639

SEQ ID NO: 806641 - protein, 169 aa, Homo sapiens
MLSKRPLLSLRSTPALSSCPGADPALTPRIRKGGLGLMSWEVVCALLLPPAPLWTPVLAPLRSLVRSAPFPPRPVLGQDVLPALRTLEQGPATPRSLYDGNRPAPSPLRGAGQPWGALKTGAGAWHRHSGQDPTSLQLLLTTPQIPRSHGKQGLAGPEATGGGDRPGSR

SEQ ID NO: 806642 - protein, 206 aa, Homo sapiens; identical to SEQ ID NO: 806639

SEQ ID NO: 806643 - protein, 206 aa, Homo sapiens; identical to SEQ ID NO: 806639

SEQ ID NO: 806644 - protein, 206 aa, Homo sapiens; identical to SEQ ID NO: 806639

SEQ ID NO: 806645 - protein, 185 aa, Homo sapiens
MLSKRPLLSLRSTPALSSCPGADPALTPRIRKGGLGLMSWEVVCALLLPPAPLWTPVLAPLRSLVRSAPFPPRPVLGQDVLPALRTLEQGPATPRSLYDGNRPAPSPLRGAGQPWGALKTGAGAWHRHSGQDPTSLQLLLTTPQIPRSHGKQGLAGPEATGGGDRPGSRHGPAGQDHPGNHRQDC

SEQ ID NO: 806646 - protein, 147 aa, Homo sapiens
MASKGLQDLKQQVEGTAQEAVSAAGAAAQQVVDQATEAGQKGLVGLEGGGQPQHTSHSPPHPGWGPGTSSPLQSPLSTMPQAGPPGDPGQAKPTGTVVPGPCLTCPLSRPSPAMDQLAKTTQETIDKTANQASDTFSGIGKKFGLLK

SEQ ID NO: 806647 - protein, 185 aa, Homo sapiens; identical to SEQ ID NO: 806645

SEQ ID NO: 806648 - protein, 188 aa, Homo sapiens [sequence omitted]

SEQ ID NO: 806649 - protein, 81 aa, Homo sapiens
PTSPHPRTSRPPWEGGLTCDIHPSSRLRNFGPERGSDRPTATRPEWGAASSTMCIYIGWQWSNTDCFLTKISQVLEVSGKD

SEQ ID NO: 806650 - protein, 147 aa, Homo sapiens
MEPVEAPSLMSWDWSRKPLLQTQAFCSMEQAGAPPSWAGLQPPKLQLWIRASLLLGEPGTGRICPSRCSCSRAGRSQGQVGALPLPSWRGGSSQVQLWLPPQAQDEGISAACTIGHPRKDSPLHPPSLQVQGCLLPLPGLSPLQQLL

SEQ ID NO: 806651 - protein, 70 aa, Homo sapiens
QDAKEGGAGKAERHLGACEIPGKDRNIGVLLGGTGTPRPLQSGQGFRSYRRVERAPRSTAGTQSSRRGIA

SEQ ID NO: 806652 - protein, 783 aa, Homo sapiens
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEESLNIEGLPSKGPIPPWLLDIKYLSPLLLAYEDMMKEKDELNATLKEEMRMFRMRVQEVVKENEELHQELNKSSAVTSEEWRQLQTQAKLVLEENKLLLEQLEIQQRKAKDSHQERLQEVSKLTKQLMLLEAKTHGQEKELAENREQLEILRAKCQELKTHSDGKIAVEVHKSIVNELKSQLQKEEEKERAEMEELMEKLTVLQAQKKSLLLEKNSLTEQNKALEAELERAQKINRKSQKKIEVLKKQVEKAMGNEMSAHQYLANLVGLAENITQERDSLMCLAKCLESEKDGVLNKVIKSNIRLGKLEEKVKGYKKQAALKLGDISHRLLEQQEDFAGKTAQYRQEMRHLHQVLKDKQEVLDQALQQNREMEGELEVIWESTFRENRRIRELLQDTLTRTGVQDNPRALVAPSLNGVSQADLLDGCDVCSYDLKSHAPTC

SEQ ID NO: 806653 - protein, 76 aa, Homo sapiens
QDAKEGGAGKAERHLGACEIPGKDRNIGVLLGGTGTPRPLQSGQGFRSYRRVERAPRSTAGTQSSRRGFGQSLGGK

SEQ ID NO: 806654 - protein, 819 aa, Homo sapiens
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPGPTLLQDLWGVAFLVGNVCGASVPLPEFLSCVQKEGDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEESLNIEGLPSKGPIPPWLLDIKYLSPLLLAYEDMMKEKDELNATLKEEMRMFRMRVQEVVKENEELHQELNKSSAVTSEEWRQLQTQAKLVLEENKLLLEQLEIQQRKAKDSHQERLQEVSKLTKQLMLLEAKTHGQEKELAENREQLEILRAKCQELKTHSDGKIAVEVHKSIVNELKSQLQKEEEKERAEMEELMEKLTVLQAQKKSLLLEKNSLTEQNKALEAELERAQKINRKSQKKIEVLKKQVEKAMGNEMSAHQYLANLVGLAENITQERDSLMCLAKCLESEKDGVLNKVIKSNIRLGKLEEKVKGYKKQAALKLGDISHRLLEQQEDFAGKTAQYRQEMRHLHQVLKDKQEVLDQALQQNREMEGELEVIWESTFRENRRIRELLQDTLTRTGVQDNPRALVAPSLNGVSQADLLDGCDVCSYDLKSHAPTC

SEQ ID NO: 806655 - protein, 356 aa, Homo sapiens
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEEVTFPIVKISFSDF

SEQ ID NO: 806656 - protein, 206 aa, Homo sapiens
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKAGETLPQK

SEQ ID NO: 806657 - protein, 508 aa, Homo sapiens [sequence omitted]

SEQ ID NO: 806658 - protein, 508 aa, Homo sapiens [sequence omitted]

SEQ ID NO: 806659 - protein, 477 aa, Homo sapiens
MELDSALEAPSQEDSNLSEELSHSAFGQAFSKILHCLARPEARRGNVKDAVLKDLGDLIEATGFDRLFEGTGARLRGMPETLGQVAKALEKYAAPSKEEEGGGDGHSEAAEKAAQVGLLFLKLLGKVETAKNSLVGPAWQTGLHHLAGPVYIFAITHSLEQPWTTPRSREVAREVLTSLLQVTECGSVAGFLHGENEDEKGRLSVILGLLKPDLYKESWKNNPAIKHVFSWTLQQVTRPWLSQHLERVLPASLVISDDYQTENKILGVHCLHHIVLNVAVLLCLLDLFPILEKTLHWKGDGARPTTHCDEVLRLILTHMEPEHRLLLRRTYARNLPAFVNRLGILTVRHLKRLERVIIGYLEVYDGPEEEARLKILETLKLLMQHTWPRVSCRLVVLLKALLKLICDVARDPNLTPESVKSALLQEATDCLILLDRCSQGRVKGLLAKIPQSCEDRKVVNYIRKVQQVSEGAPYNGT

SEQ ID NO: 806660 - protein, 477 aa, Homo sapiens; identical to SEQ ID NO: 806659

SEQ ID NO: 806661 - protein, 508 aa, Homo sapiens [sequence omitted]

SEQ ID NO: 806662 - protein, 435 aa, Homo sapiens
MELDSALEAPSQEDSNLSEELSHSAFGQAFSKILHCLARPEARRGNVKDAVLKDLGDLIEATGFDRLFEGTGARLRGMPETLGQVAKALEKYAAPSKEEEGGGDGHSEAAEKAAQVGLLFLKLLGKVETAKNSLVGPAWQTGLHHLAGPVYIFAITHSLEQPWTTPRSREVAREVLTSLLQVTECGSVAGFLHGENEDEKGRLSVILGLLKPDLYKESWKNNPAIKHVFSWTLQQVTRPWLSQHLERVLPASLVISDDYQTENKILGVHCLHHIVLNVPAADLLQYNRAQVLYHAISNHLYTPEHHLIQAVLLCLLDLFPILEKTLHWKGDGARPTTHCDEVLRLILTHMEPEHRLLLRRTYARNLPAFVNRLGILTVRHLKRLERVIIGYLEVYDGPEEEARLKILETLKLLMQHTWPRVSWPKFPKAVKTEKW

SEQ ID NO: 806663 - protein, 125 aa, Homo sapiens
MELDSALEAPSQEDSNLSEELSHSAFGQAFSKILHCLARPEARRGNVKDAVLKDLGDLIEATGFDRLFEGTGARLRGMPETLGQVAKALEKYAAPSKEEEGLGPPFWLSPKNGGGRGGPPPFRGS

SEQ ID NO: 806664 - protein, 117 aa, Homo sapiens
MGLTPMHIPSITKHIYVYIRTQEHGITQVDNTYLLPKTQQRFKNNNGDMLTGMLIGMCPACLCAGLGTEYGNTNQTPKIYSCDLKHVSPCSKFVQFHVCVAFTDFILIVFLCQRSLC

SEQ ID NO: 806665 - protein, 75 aa, Homo sapiens
QRSHQTPGLPAPCSLEAPDPSPAPTVTREVQYGVVLPSIVRNHRSVNSLVLFGQLERRMSDGGVSMGSRRRDGYQ

SEQ ID NO: 806666 - protein, 587 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806667 - protein, 601 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQVFLPPRPPKVLGLQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806668 - protein, 510 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806669 - protein, 580 aa, Homo sapiens
ERKSLVYERSGGPVRGSDLPAELTLRDPGHCCCCGSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806670 - protein, 215 aa, Homo sapiens
MRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAS

SEQ ID NO: 806671 - protein, 587 aa, Homo sapiens; identical to SEQ ID NO: 806666

SEQ ID NO: 806672 - protein, 253 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVG

SEQ ID NO: 806673 - protein, 569 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806674 - protein, 437 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806675 - protein, 460 aa, Homo sapiens
MNFLEGREKADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806676 - protein, 404 aa, Homo sapiens
MAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806677 - protein, 234 aa, Homo sapiens
MRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806678 - protein, 475 aa, Homo sapiens
ERKSLVYERSGGPVRGSDLPAELTLRDPGHCCCCGREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806679 - protein, 333 aa, Homo sapiens
MRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806680 - protein, 574 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKVRSPFGLLACTVK

SEQ ID NO: 806681 - protein, 540 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGITSASSQTLRGHVLCRTTLRDSSAYC

SEQ ID NO: 806682 - protein, 429 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGSGLLGEGASLTFPCFLNDQTVSLLPRT

SEQ ID NO: 806683 - protein, 374 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDESAGPL

SEQ ID NO: 806684 - protein, 378 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVSVRLAVTN

SEQ ID NO: 806685 - protein, 189 aa, Homo sapiens [sequence omitted]

SEQ ID NO: 806686 - protein, 221 aa, Homo sapiens
ERKSLVYERSGGPVRGSDLPAELTLRDPGHCCCCGRYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806687 - protein, 189 aa, Homo sapiens [sequence omitted]

SEQ ID NO: 806688 - protein, 134 aa, Homo sapiens
MGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 806689 - protein, 128 aa, Homo sapiens
KPRRVCVGGKRRRDDISVDSLDFTKKILHTAWHPAENIIAIAATNNLYPVGAVEGLSKRSATDLCGRNDGNLKVIFPDAEMEDVNNPGLRVRAQPGDYVLVKITSASSQTLRGHVLCRTTLRDSSAYC

SEQ ID NO: 806690 - protein, 89 aa, Homo sapiens
MDSRGNGCSNIQFPESAAPAAVSCADGVGREMDTGYVSMIFRNLAPYCHPTTRTLKTVKILSPDMDPTVAQDVGSNFIAVCYLIKFTKG

SEQ ID NO: 806691 - protein, 84 aa, Homo sapiens
VPGARPRAPRFEPLGHETASPSTMQLSAHQKTPLQSTHRPQKEYPEEPEHTPPYLFSEIQSNESLYFSGSRKRLEVFLQVSSSM

SEQ ID NO: 806692 - protein, 146 aa, Homo sapiens
VPGARPRAPRFEPLGHETASPSTMQLSAHQKTPLQSTHRPQKEYPEEPEHTPPYLFSEIQSNESLYFSGSRKRLEVFLQQQTARQTLRQELLSRSSSHQILCAGNPPLLSTLCAPLPVTVHVKQWYGKIVCRRMKRLYCQTLKVFC

SEQ ID NO: 806693 - protein, 124 aa, Homo sapiens [sequence omitted]

SEQ ID NO: 806694 - protein, 144 aa, Homo sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRFPTVLSTSPAAHGGPRCPGEIIEGPHSAKRSLWKKQPVHRCPGSLRAQS

SEQ ID NO: 806695 - protein, 118 aa, Homo sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 806696 - protein, 112 aa, Homo sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRCVGVVGDPCGTAADWSH

SEQ ID NO: 806697 - protein, 128 aa, Homo sapiens
MCTAWSWLSAGRGDAHGGGGEPVQTLGPCTCSLMVLIPSGPSRDTACFTRSVRPQFSIRKPRSCLNLASMATASSFRDAQKQSSALRKGRDIMRVQRLPRGAQEQTPQEAPWDIAFAFHVNCLFLGSN

SEQ ID NO: 806698 - protein, 110 aa, Homo sapiens
NCLLDRSDTDGNVSQSSAIDLRKRCSQLEGHSGTRVGSSLRQTFSFLSGMTGKAKTREKEEMKEAKDARYTNGHLFTTISVSGMTMCYACNKSITAKEALICPTCNVTIH

SEQ ID NO: 806699 - protein, 98 aa, Homo sapiens
VRRLRAPGRREEAAKAQGRGPARGKEPQRQPPGARDGAGDGAAGTRPVTSKGPSERPTAETRGADSVLNRGQRQPQQRHGPVLPPRTDSAADSSHLQW

SEQ ID NO: 806700 - protein, 170 aa, Homo sapiens
GRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIK

SEQ ID NO: 806701 - protein, 120 aa, Homo sapiens
GRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIR

SEQ ID NO: 806702 - protein, 146 aa, Homo sapiens
HHGHVDGPQEAVMHLDQVLQVNEDSCHVRRAQHQPQGAHVVLLNVLQGAVVLGLGLLDLHELFDPFDLFDVRDFGKVISAVSRLSLHSIAQNKGIRPFPSEETTENDDDVYRSLEELADEHDLGEDIYDCVPCEDGGDDIYEDIIK

SEQ ID NO: 806703 - protein, 118 aa, Homo sapiens
MSAIWRLLAAKGDEQAKVARPACRPRAAAVSCHQPSPDTQDACLTQKHSYVRPLRGSASCHCYQKKKPSKQKGQCHTRQPGAQQNKWPPKALWGPHPATDPSTVWFPGLQDPPGDLSA

SEQ ID NO: 806704 - protein, 118 aa, Homo sapiens; identical to SEQ ID NO: 806703

SEQ ID NO: 806705 - protein, 487 aa, Homo sapiens
MAAPTLGRLVLTHLLVALFGMGSWAAVNGIWVELPVVVKDLPEGEWEGGTGKRGAGMPRKVACGSSLSLSHCAPDMASSFPAGWSLPSYLSVVVALGNLGLLVVTLWRRLAPGKGEQVPIQVVQVLSVVGTALLAPLWHHVAPVAGQLHSVAFLTLALVLAMACCTSNVTFLPFLSHLPPPFLRSFFLGQGLSALLPCVLALVQGVGRLECPPAPTNGTSGPPLDFPERFPASTFFWALTALLVTSAAAFRGLLLLLPSLPSVTTGGSGPELQLGSPGAEEEEKEEEEALPLQEPPSQAAGTIPGPDPEAHQLFSAHGAFLLGLMAFTSAVTNGVLPSVQSFSCLPYGRLAYHLAVVLGSAANPLACFLAMGVLCRSLAGLVGLSLLGMLFGAYLMALAILSPCPPLVGTTAGVVLVVLSWVLCLCVFSYVKVAASSLLHGGGRPALLAAGVAIQVGSLLGAGAMFPPTSIYHVFQSRKDCVDPCGP

SEQ ID NO: 806706 - protein, 448 aa, Homo sapiens
MAAPTLGRLVLTHLLVALFGMGSWAAVNGIWVELPVVVKDLPEGWSLPSYLSVVVALGNLGLLVVTLWRRLAPGKGEQVPIQVVQVLSVVGTALLAPLWHHVAPVAGQLHSVAFLTLALVLAMACCTSNVTFLPFLSHLPPPFLRSFFLGQGLSALLPCVLALVQGVGRLECPPAPTNGTSGPPLDFPERFPASTFFWALTALLVTSAAAFRGLLLLLPSLPSVTTGGSGPELQLGSPGAEEEEKEEEEALPLQEPPSQAAGTIPGPDPEAHQLFSAHGAFLLGLMAFTSAVTNGVLPSVQSFSCLPYGRLAYHLAVVLGSAANPLACFLAMGVLCRSLAGLVGLSLLGMLFGAYLMALAILSPCPPLVGTTAGVVLVVLSWVLCLCVFSYVKVAASSLLHGGGRPALLAAGVAIQVGSLLGAGAMFPPTSIYHVFQSRKDCVDPCGP

SEQ ID NO: 806707 - protein, 448 aa, Homo sapiens; identical to SEQ ID NO: 806706

SEQ ID NO: 806708 - protein, 111 aa, Homo sapiens
VRLELSRACPVLGHPAKHPRPQRWCKVNFSYSPEQADELKLQAGEIVEMIKEALVTQTCLQSARVPSGLPRPQRIRAGGKESVKDEEEFFQTTLYSHHPQLRMLNLYFFSA

SEQ ID NO: 806709 - protein, 586 aa, Homo sapiens
MDTSRILQKLHHPEVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 806710 - protein, 755 aa, Homo sapiens
MEVLVLAGYRAQKEDELSLAPGDVVRQVRWVPARGWLRGEFGGRYGLFPERLVQEIPETLRGSGEARRPRCARRRGHPAKHPRPQRWCKVNFSYSPEQADELKLQAGEIVEMIKEIEDGWWLGKKNGQLGAFPSNFVELLDSGPPSLGNPDMPSVSPGPQRPPKLSSLAYDSPPDYLQTATLQVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 806711 - protein, 548 aa, Homo sapiens
ALEGAPETMEVLVLAGYRAQKEDELSLAPGDVVRQVRWVPARGWLRGEFGGRYGLFPERLVQEIPETLRGSGEARRPRCARRRGHPAKHPRPQRWCKVNFSYSPEQADELKLQAGEIVEMIKEIEDGWWLGKKNGQLGAFPSNFVELLDSGPPSLGNPDMPSVSPGPQRPPKLSSLAYDSPPDYLQTATLQVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQRH

SEQ ID NO: 806712 - protein, 142 aa, Homo sapiens
ALEGAPETMEVLVLAGYRAQKEDELSLAPGDVVRQVRWVPARGWLRGEFGGRYGLFPERLVQEIPETLRGSGEARRPRCARRRGHPAKHPRPQRWCKVNFSYSPEQADELKLQAGEIVEMIKEALVTQTCLQSARVPSGLPS

SEQ ID NO: 806713 - protein, 755 aa, Homo sapiens; identical to SEQ ID NO: 806710

SEQ ID NO: 806714 - protein, 444 aa, Homo sapiens
CTGEVSQAKGNQTQPQLRLHLPSRQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 806715 - protein, 585 aa, Homo sapiens
ALEGAPETMEVLVLAGYRAQKEDELSLAPGDVVRQVRWVPARGWLRGEFGGRYGLFPERLVQEIPETLRGSGEARRPRCARRRGHPAKHPRPQRWCKVNFSYSPEQADELKLQAGEIVEMIKEIEDGWWLGKKNGQLGAFPSNFVELLDSGPPSLGNPDMPSVSPGPQRPPKLSSLAYDSPPDYLQTATLQVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPSSLGWGLCQELGSSRVEFLDELVPTERASGSSRSPQHT

SEQ ID NO: 806716 - protein, 63 aa, Homo sapiens
MLGRGWFPAVVCTGEVSQAKGNQTQPQLRLHLPSRQEEEHSSPVKAPSVKRTPMPDKTATPER

SEQ ID NO: 806717 - protein, 160 aa, Homo sapiens
EGNTDVPGAGSLRLLWAYVAQLGARLVLEGAALGLQYHLYGFQMPSSFACRREPCLGSITCNLSRPSEKTIFLKTMFGVSGFCLLFTFLELVLLGLGRWWRTWKHKSSSSKYFLTSESTRRHKKATDSLPVVETKEQFQEAVPGRSLAQEKQRPVGPRDA

SEQ ID NO: 806718 - protein, 331 aa, Homo sapiens
ADAKRRDWKRKQGPYFEQPLQWKVTEDCQVQLTCKVTNTKKETRFQWFFQRAEMPDGQYDPETGTGLLCIEELSKKDKGIYRAMVSDDRGEDDTILDLTGDALDAIFTELGRIGALSATPLKIQGTEEGIRIFSKVKYYNVEYMKTTWFHKDKRLESGDRIRTGTTLDEIWLHILDPKDSDKGKYTLEIAAGKEVRQLSTDLSGQAFEDAMAEHQRLKTLAIIEKNRAKVVRGLPDVATIMEDKTLCLTCIVSGDPTPEISWLKNDQPVTFLDRYRMEVRGTEVTITIEKVNSEDSGRYGVFVKNKYGSETGQVTISVFKHGDEPKELKSM

SEQ ID NO: 806719 - protein, 115 aa, Homo sapiens
MPKWPQGRFILLLCLPSPLCNSTENPGDRGRDPDLQQGQVLQRGVHENHLVPQVSPPCPRTPARLERIQHLTHGGLPPFSLPGPPSRVSGPPSRAWSQGLAETESLPGLAVHRRS

SEQ ID NO: 806720 - protein, 131 aa, Homo sapiens
QALSVLPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 806721 - protein, 86 aa, Homo sapiens
AGPSCFRMQHCFGGTCTGVVKGTVTHFMLAVLSWWEISGWPTSGYMSMDRNSADPAAPALKTELLAERSWWSPVAFQRSQEPKAGS

SEQ ID NO: 806722 - protein, 131 aa, Homo sapiens; identical to SEQ ID NO: 806720

SEQ ID NO: 806723 - protein, 188 aa, Homo sapiens
MAHLLGSQACMESLRTDLTDLQGAIVDVFSRAGPVRFPSWKFPDRMACDLDMVALLEHYDHVPGDPEFTQLSHAVLLELVIDRLLLLLQSCMSYLENLGSEQMMPPAQAAGPCMSVGLTVRRFWDSLLRLGTLHQQPLPQKGANQRETPTSKPTTKGEPARSPEYLTTKLIKPSSPVLGLPQTCQEPE

SEQ ID NO: 806724 - protein, 85 aa, Homo sapiens
VPCRAAGAGHRQVRALTKPGHLRMPAPAPETSGSYGSPSRGRGDVGTTVTIEYLSGPHQLRTFKVVLPFIMCLVLCAVLSCVRLS

SEQ ID NO: 806725 - protein, 4344 aa, Homo sapiens
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWVREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETEEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVKVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHTKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISVLRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIQQ

SEQ ID NO: 806726 - protein, 3351 aa, Homo sapiens
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWVREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETEEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVKVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHTKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRWESGSSS

SEQ ID NO: 806727 - protein, 2299 aa, Homo sapiens
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWVREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETEEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVKVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHTKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQVRFFFVHLLLRF

SEQ ID NO: 806728 - protein, 4368 aa, Homo sapiens
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWVREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETEEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVKVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHTKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISVLRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAH

SEQ ID NO: 806729 - protein, 1141 aa, Homo sapiens
MQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISVLRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 806730 - protein, 196 aa, Homo sapiens
WQRDAAPGWRAGACVGELEMESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGAPNLSRVEELDEPMFSDIALNIDQDL

SEQ ID NO: 806731 - protein, 177 aa, Homo sapiens
MESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGAPNLSRVEELDEPMFSDIALNIDQDL

SEQ ID NO: 806732 - protein, 177 aa, Homo sapiens; identical to SEQ ID NO: 806731

SEQ ID NO: 806733 - protein, 177 aa, Homo sapiens; identical to SEQ ID NO: 806731

SEQ ID NO: 806734 - protein, 363 aa, Homo sapiens
MPVRSGSGTVSSWDRNALRTQPGAEPPESGELNEIRRDHQPDPNLASLPASWSPKRQGLERTGSQNSGPGRTTAESLFLVLKRSVLEERGRLPAWYRAAAAAGNCPVLKTDAARPAELRPKPAAPSGARTELLEALTQSAGRAGAASSKPGMDLQRPDSYQGGAGPDFNDHVLHKTILVGDSGVGKTSLLVQFDQGKFIPGSFSATVGIGFTNKVVTVDGRESEAAILGHRWAGTVRRRPHAYYRDAQPASAGVTSPTNLLSTNIRGWLTENHEYCPRDVVNQCMAKENQAGELEQRKGVDTDPKESGKTLWPRRIRGALPGDTNAQKEGGMWGEPSWDTTTEKEITAAQQEREATDRYTENY

SEQ ID NO: 806735 - protein, 261 aa, Homo sapiens
MPVRSGSGTVSSWDRNALRTQPGAEPPESGELNEIRRDHQPDPNLASLPASWSPKRQGLERTGSQNSGPGRTTAESLFLVLKRSVLEERGRLPAWYRAAAAAGNCPVLKTDAARPAELRPKPAAPSGARTELLEALTQSAGRAGAASSKPGMDLQRPDSYQGGAGPDFNDHVLHKVNISCIPQPNVGRGASTRSFLHSPDFALGLNEKLACICESGEPFLSDPVSCSKQRCVSSWGRAAARGSDGQKLHSFTYIICVPFSP

SEQ ID NO: 806736 - protein, 304 aa, Homo sapiens
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKDGVSLLLPRLEYNDAVSAHCNLHLWVQVILLPQPPE

SEQ ID NO: 806737 - protein, 272 aa, Homo sapiens
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKGRTH

SEQ ID NO: 806738 - protein, 517 aa, Homo sapiens
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKGENWLYRNQKKWDINLPQEAFIPETIYTEEEDFECSENKKSFDINSVSSICAIQLGIPSRKGSPKCDKFKTYFKFNLDSVGKQHSEYEYGNDLSLSTDIRHQKSHTTMNSYECYQCGKAFCRSSSLIRHQIIHTGEKPYKCSECGRFFNRRTNLTKHQKLHAEAKACTSNKCGKAFSKSEDSNNPTLHFGNNFYQCVNCGKSFNRSSSLIRHQMIHTGEKPFKCKECSKAFNRSSNLVKHQKLHTRDKS

SEQ ID NO: 806739 - protein, 277 aa, Homo sapiens
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKDHSHRRETL

SEQ ID NO: 806740 - protein, 272 aa, Homo sapiens; identical to SEQ ID NO: 806737

SEQ ID NO: 806741 - protein, 1111 aa, Homo sapiens
SSLLEKMTSSDKDFRFMATSDLMSELQKDSIQLDEDSERKVVKMLLRLLEDKNGEVQNLAVKWLGVPLGAFHASLLHCLLPQLSSPRLAVRKRAVGALGHLAAACSTDLFVELADHLLDRLPGPRVPTSPTAIRTLIQCLGSVGRQAGHRLGAHLDRLVPLVEDFCNLDDDELRESCLQAFEAFLRKCPKEMGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTRPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKVKAGSVKQEFEKQDELKRSAMRAVAALLTIPEVGKSPIMADFSSQIRSNPELAALFESIQKDSASAPSTDSMELS

SEQ ID NO: 806742 - protein, 145 aa, Homo sapiens
SSGPKLHVCTPTWPHSARAAPAAPFTHPQHLPDWWASELENDSLPGAFLILLGSSKCSWQRKCHHLRKQTQRGRDSGRTSRWSELGLQVSVVGPLLFPRAGCCSCSCTISLRTISFLWADADLHHGCPAGHPVSCTCPAEGGPTH

SEQ ID NO: 806743 - protein, 944 aa, Homo sapiens
MGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTRPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIGEFMESLQDPDLNVRRATLAFFNSAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKVKAGSVKQEFEKQDELKRSAMRAVAALLTIPEVGKSPIMADFSSQIRSNPELAALFESIQKDSASAPSTDSMELS

SEQ ID NO: 806744 - protein, 1142 aa, Homo sapiens
MRSDKEQLRDIAGIGLKTVLSELPPAATGSGLATNVCRKITGQLTSAIAQQEDVAVQLEALDILSDMLSRLGVPLGAFHASLLHCLLPQLSSPRLAVRKRAVGALGHLAAACSTDLFVELADHLLDRLPGPRVPTSPTAIRTLIQCLGSVGRQAGHRLGAHLDRLVPLVEDFCNLDDDELRESCLQAFEAFLRKCPKEMGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTRPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIGEFMESLQDPDLNVRRATLAFFNSAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKVKAGSVKQEFEKQDELKRSAMRAVAALLTIPEVGKSPIMADFSSQIRSNPELAALFESIQKDSASAPSTDSMELS

SEQ ID NO: 806745 - protein, 944 aa, Homo sapiens; identical to SEQ ID NO: 806743

SEQ ID NO: 806746 - protein, 948 aa, Homo sapiens
MGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTRPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIGEFMESLQDPDLNVRRATLAFFNSAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKEPNANSVAWNTQCEDMLLCFSGGGYLNIKASTFPMHRQKLQGFVVGYNGSKIFCLHVFSISAVEVPQIGEDEGPEVQEH

SEQ ID NO: 806747 - protein, 36 aa, Homo sapiens
MESLQDPDLNVRRATLAFFNSAVHNKPSLVRDLLDD

SEQ ID NO: 806748 - protein, 80 aa, Homo sapiens
MSWKVRRAAAKCIAALISSRPDLLPDFHCTLAPVLIRRFKEREENVKADVFTAYIVLLRQTRPPKGWLEAMEEPTQTGSN

SEQ ID NO: 806749 - protein, 238 aa, Homo sapiens
EGRTLLGQKEHILRRRGPCLPHQALGHQEDPHLQASLAFQGERGPCSSFIMNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 806750 - protein, 205 aa, Homo sapiens
EGRTLLGQKEHILRRRGPCLPHQALGHQEDPHLQASLAFQGERGPCSSFIMNWHMIISGLIVVVLKVVGMTLFLLYFPQIFNKSNDGFTTTRSYGTVCPKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 806751 - protein, 185 aa, Homo sapiens
EGRTLLGQKEHILRRRGPCLPHQALGHQEDPHLQASLAFQGERGPCSSFIMNWHMIISGLIVVVLKVVGMTLFLLYFCPKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 806752 - protein, 88 aa, Homo sapiens
CWGRSRGYTHTQQAEGIDIRRGTGVSTDVSEFMRGRELAAGPVPPAGSPTPSLHYDHGKMPEAQRSGVFEADRLFSPSAWGRNTPGGH

SEQ ID NO: 806753 - protein, 134 aa, Homo sapiens
MGHLQAAAETLHRAPAGGHRVAQQEHRDAPLLNQSPLHRLRSRSGPATEGNGTRVSVWTLHLPALLRSPFLARSQKASSTSRASPKLKRKKISLEPLSTYLFSNRLLQLCFLQTTQPERAKREKRNKSEALPLK

SEQ ID NO: 806754 - protein, 187 aa, Homo sapiens
CVRVSSRQQGEPEAAGARTMSSPGPSQPPAEDPPWPARLLRAPLGLLRLDPSGGALLLCGLVALLGWSWLRRRRARGIPPGPTPWPLVGNFGHVLLPPFLRRRSWLSSRTRAAGIDPSVIGPQVLLAHLARVYGSIFSFFIGHYLVVVLSDFHSVREALVQQAEVFSDRPRVPLISIVTKEKELFQE

SEQ ID NO: 806755 - protein, 71 aa, Homo sapiens
PWLQEFGTRTSPLRGDGAKSRKEVRKLKSRERQWQGQVAKCTQPSQQGVCHSRLKDVFEELLSQWDAALKS

SEQ ID NO: 806756 - protein, 70 aa, Homo sapiens
WNSEMSTSLSVVPRQLNFCISSGSRSTSMPSMAGTGHPLPRLFTTKPPPRRRARGPGGGPLLASFATPLL

SEQ ID NO: 806757 - protein, 385 aa, Homo sapiens
AQTPQPPTAPKGASDAKLCALYKEAELRLKGSSNTTECVPVPTSEHVAEIVGRQGCKIKALRAKTNTYIKTPVRGEEPVFMVTGRREDVATARREIISAAEHFSMIRASRNKSGAAFGVAPALPGQPDRDPVFEITGAPGNVERAREEIETHIAVRTGKILEYNNENDFLAGSPDAAIDSRYSDAWRVHQPGCKPLSTFRQNSLGCIGECGVDSGFEAPRLGEQGGDFGYGGYLFPGYGVGKQDVYYGVAETSPPLWAGQENATPTSVLFSSSSSSSSSAKARAGPPGAHRSPATSAGPELAGLPRRPPGEPLQGFSKLGGGGLRSPAAGGRDCMVCFESEVTAALVPCGHNLFCMECAVRICERTDPECPVCHITATQAIRIFS

SEQ ID NO: 806758 - protein, 423 aa, Homo sapiens
AQTPQPPTAPKGASDAKLCALYKEAELRLKGSSNTTECVPVPTSEHVAEIVGRQGCKIKALRAKTNTYIKTPVRGEEPVFMVTGRREDVATARREIISAAEHFSMIRASRNKSGAAFGVAPALPGQVTIRVRVPYRVVGLVVGPKGATIKRIQQQTNTYIITPSRDRDPVFEITGAPGNVERAREEIETHIAVRTGKILEYNNENDFLAGSPDAAIDSRYSDAWRVHQPGCKPLSTFRQNSLGCIGECGVDSGFEAPRLGEQGGDFGYGGYLFPGYGVGKQDVYYGVAETSPPLWAGQENATPTSVLFSSSSSSSSSAKARAGPPGAHRSPATSAGPELAGLPRRPPGEPLQGFSKLGGGGLRSPAAGGRDCMVCFESEVTAALVPCGHNLFCMECAVRICERTDPECPVCHITATQAIRIFS

SEQ ID NO: 806759 - protein, 423 aa, Homo sapiens; identical to SEQ ID NO: 806758

SEQ ID NO: 806760 - protein, 113 aa, Homo sapiens
CFVSGGCSSGMSLCGIVVPTVSRFPPGGFFYMCVGIPSPLFSLSPFFPGYPSYVPLFPLCRSWWPARRSHNHVFLLRDSFRGGRGAAPHTCCVFFFFFFLLVFGVQYSGFNHR

SEQ ID NO: 806761 - protein, 105 aa, Homo sapiens
ATITSLRLAAKVNEEEEFIPQVKDFTKHYGSDYSPNELLRMELAILDRLHWDLYIGTPLDFLTIVSKEVFTESTLNSFVPLEQLFTTWDGKAQACTRPCTCTTVR

SEQ ID NO: 806762 - protein, 70 aa, Homo sapiens
ATITSLRLAAKVNEEEEFIPQVKDFTKHYGSDYSPNELLRMELAILDRLHWDLYIGTPLDFLTINGNIVI

SEQ ID NO: 806763 - protein, 105 aa, Homo sapiens [sequence omitted]

SEQ ID NO: 806764 - protein, 224 aa, Homo sapiens
WDLLPAAGGGAMAALLRAVRRFRGKAVWERPLHGLWCCSGQEDPKRWVGSSSPISKEKLPNAETEKFWMFYRFDAIRTFGFLSRLKLAQTALTVVALPPGYYLYSQGLLTLNTVCLMSGISGFALTMLCWMSYFLRRLVGILYLNESGTMLRVAHLNFWGWRQDTYCPMADVIPLTETKDRPQEMFVRIQRYSGKQTFYVTLRYGRILDRERFTQVFGVHQMLK

SEQ ID NO: 806765 - protein, 173 aa, Homo sapiens
VRGSPRRGTNAETEKFWMFYRFDAIRTFGFLSRLKLAQTALTVVALPPGYYLYSQGLLTLNTVCLMSGISGFALTMLCWMSYFLRRLVGILYLNESGTMLRVAHLNFWGWRQDTYCPMADVIPLTETKDRPQEMFVRIQRYSGKQTFYVTLRYGRILDRERFTQVFGVHQMLK

SEQ ID NO: 806766 - protein, 224 aa, Homo sapiens; identical to SEQ ID NO: 806764

SEQ ID NO: 806767 - protein, 224 aa, Homo sapiens; identical to SEQ ID NO: 806764

SEQ ID NO: 806768 - protein, 582 aa, Homo sapiens
MESVKQRILAPGKEGLKNFAGKSLGQIYRVLEKKQDTGETIELTEDGKPLEVPERKAPLCDCTCFGLPRRYIIAIMSGLGFCISFGIRCNLGVAIVDMVNNSTIHRGGKVIKEKAKFNWDPETVGMIHGSFFWGYIITQIPGGYIASRLAANRVFGAAILLTSTLNMLIPSAARVHYGCVIFVRILQGLVEGVTYPACHGIWSKWAPPLERSRLATTSFCGSYAGAVIAMPLAGILVQYTGWSSVFYVYGSFGMVWYMFWLLVSYESPAKHPTITDEERRYIEESIGESANLLGAMEKFKTPWRKFFTSMPVYAIIVANFCRSWTFYLLLISQPAYFEEVFGFEISKVGMLSAVPHLVMTIIVPIGGQIADFLRSKQILSTTTVRKIMNCGGFGMEATLLLVVGYSHTRGVAISFLVLAVGFSGFAISGFNVNHLDIAPRYASILMGISNGVGTLSGMVCPIIVGAMTKNKSREEWQYVFLIAALVHYGGVIFYAIFASGEKQPWADPEETSEEKCGFIHEDELDEETGDITQNYINYGTTKSYGATTQANGGWPSGWEKKEEFVQGEVQDSHSYKDRVDYS

SEQ ID NO: 806769 - protein, 71 aa, Homo sapiens
RVSVGSPHVSAASRSSPPLAGFCFHLLISQSLILTQSKILNINTTTEAYYVLLSLLLLPPKCWRRGLVEGD

SEQ ID NO: 806770 - protein, 68 aa, Homo sapiens
RVSVGSPHVSAASRSSPPLAGFCFHLLISQSLILTQSKILNINTTTEAYYVLLSLLLLPPKHCKLFGI

SEQ ID NO: 806771 - protein, 588 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 806772 - protein, 684 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 806773 - protein, 344 aa, Homo sapiens
MFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 806774 - protein, 691 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVMPKWPEARGT

SEQ ID NO: 806775 - protein, 603 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLSGDQDHPG

SEQ ID NO: 806776 - protein, 231 aa, Homo sapiens
AAWLIKYEGGHMALMGDPCLCHHSEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 806777 - protein, 718 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 806778 - protein, 636 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 806779 - protein, 344 aa, Homo sapiens; identical to SEQ ID NO: 806773

SEQ ID NO: 806780 - protein, 702 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPESLNF

SEQ ID NO: 806781 - protein, 473 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQAEADGS

SEQ ID NO: 806782 - protein, 169 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKADNPGLRAACFGADLPGTYSCCSTLPEARGFTGSASPVVQG

SEQ ID NO: 806783 - protein, 105 aa, Homo sapiens
GATRFEVQTRRRGRERVCLWGCCGTVCARRAAENPAWSACSPPSGVAPAAGLRRDRHAGAHGRAPVSLEPRAPRRATALQVAQTAGASATPRPAASCEVSQTRFD

SEQ ID NO: 806784 - protein, 335 aa, Homo sapiens
ACALVVFSVDCMLTSPCLLVRFFSIFVVYSGAGYACVGRICLWLCFFCSAAVRVVELCVLLFSLLLGSYFAWVAAACASSLWCVLCACRIRRLVVCCVYQLDLVLRRSPRLCWRLVVVFSACYFLFVAAAASRAVSRVAVLMAFSTFVWCVVVCWRGCASLFMFPRGALCCRPRFVGRLWFAVPSHSSVLFSLRGTIARGGFAGPRLSGLPRYARPVVCSLSPLRLVLACAWFAWRCPMVLVLLDSVFGGLWSFLVCAALWQSLRDPLVARPRGSTVTRASCAALVSSIACRGTCSHLSPSRPLLASVGCAGGAGPGLTTCVMVPSSGTGCRLRY

SEQ ID NO: 806785 - protein, 104 aa, Homo sapiens
LEQVPPLSNEASPVRPAQKLGNLLVSAFSVSGTHCCLGNPLSGPVISHLQIQGISEVRERREASSEILTSIQVLHSWNQPTLDGKDLENNKNNTTIKIPIKIQY

SEQ ID NO: 806786 - protein, 433 aa, Homo sapiens
QKKWLDQEMEKVLQQRRALEELGEELHKREAILAKKEALMQEKTGLESKRLRSSQALNEDIVRVSSRLEHLEKELSEKSGQLRQGSAQSQQQIRGEIDSLRQEKDSLLKQRLEIDGKLRQGSLLSPEEERTLFQLDEAIEALDAAIEYKNEAITCRQRVLRASASLLSQCEMNLMAKLSYLSSSETRALLCKYFDKVVTLREEQHQQQIAFSELEMQLEEQQRLVYWLEVALERQRLEMDRQLTLQQKEHEQNMQLLLQQSRDHLGEGLADSRRQYEARIQALEKELGRYMWINQELKQKLGGVNAVGHSRGGEKRSLCSEGRQAPGNEDELHLAPELLWLSPLTEGAPRTREETRDLVHAPLPLTWKRSSLCGEEQGSPEELRQREAAEPLVGRVLPVGEAGLPWNFGPLSKPRRELRRASPGMIDVRKNPL

SEQ ID NO: 806787 - protein, 124 aa, Homo sapiens [sequence omitted]

SEQ ID NO: 806788 - protein, 403 aa, Homo sapiens
QKKWLDQEMEKVLQQRRALEELGEELHKREAILAKKEALMQEKTGLESKRLRSSQALNEDIVRVSSRLEHLEKELSEKSGQLRQGSAQSQQQIRGEIDSLRQEKDSLLKQRLEIDGKLRQGSLLSPEEERTLFQLDEAIEALDAAIEYKNEAITCRQRVLRASASLLSQCEMNLMAKLSYLSSSETRALLCKYFDKVVTLREEQHQQQIAFSELEMQLEEQQRLVYWLEVALERQRLEMDRQLTLQQKEHEQNMQLLLQQSRDHLGEGLADSRRQYEARIQALEKELGRYMWINQELKQKLGGVNAVGHSRGGEKRSLCSEGRQAPGNEDELHLAPELLWLSPLTEGAPRTREETRDLVHAPLPLTWKRSSLCGDSSTTPISGPGSEDLEEPHAQGLLHTTCN

SEQ ID NO: 806789 - protein, 269 aa, Homo sapiens
MNSSSSSSVPKSMALRASAMCSKSKVKKSMFSKPCSVFPSWQPLEASTMLLMSCLAVKRKVAPPGSSRDWMAVSTSFVDLSSCSWYCWMRASMKLSFSSCSCVIRCSNSLFFSSRMAYNVSNFWLSSSFYLVTVLLGHSTGILQLSDDGLHTVIPRHQHGDTVIQFSLLSLEDTLQWGHLAGLVDPKHLAHGAGGHLTRETVDVDFLIFVLLAHGVTALLQRPTGALLFVDVDDVLHQQVPLQAVHSVTIHDHLVAAGGAAETASRHGH

SEQ ID NO: 806790 - protein, 269 aa, Homo sapiens; identical to SEQ ID NO: 806789

SEQ ID NO: 806791 - protein, 147 aa, Homo sapiens [sequence omitted]

SEQ ID NO: 806792 - protein, 668 aa, Homo sapiens
RKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMEKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAVAGSFSCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 806793 - protein, 668 aa, Homo sapiens; identical to SEQ ID NO: 806792

SEQ ID NO: 806794 - protein, 847 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806795 - protein, 248 aa, Homo sapiens
CTSAFCSQMLPGSLKREDTRKQVKIILLLFCIQQASYYGTAVMGQAYLPELGTQWGPPWLSLTGVTTGCRQTPVLSILLARPAESSESRVGYWMPRREEGAREVSPKVLQGPQQAWTEEVWTAWPCPEPLCIITAVPNLHPTLSLPIPGPGALLLCSRDSWSSLRQHTVLLWRRPSPTHAGMLQPVPEQVVAGGCWQRRDNGPAPGGKCWLQGTESSPCHSPCYPLGNLKGISKNSGSATLLSFLWNM

SEQ ID NO: 806796 - protein, 280 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLGIRAFPGKPQEGGARGQTAVGHRGNRAGAQGAQNKK

SEQ ID NO: 806797 - protein, 350 aa, Homo sapiens
YFCLLLSDAARVPEEGRHAETGLHPDTTPCISSAPGSCSWHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTRKWDHVTPVMHSGGGTWEHDREVTAQNPEQQKGPGKVDQLKTKIQQLAMPGKGEGGQTGRRREMPRTAHRTPREKHKRDPQEHERGEHRAKTEAQA

SEQ ID NO: 806798 - protein, 670 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806799 - protein, 670 aa, Homo sapiens; identical to SEQ ID NO: 806798

SEQ ID NO: 806800 - protein, 839 aa, Homo sapiens
MVSFLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806801 - protein, 843 aa, Homo sapiens
TRRHAETVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806802 - protein, 857 aa, Homo sapiens
YFCLLLSDAARVPEEGRHAETVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806803 - protein, 670 aa, Homo sapiens; identical to SEQ ID NO: 806798

SEQ ID NO: 806804 - protein, 835 aa, Homo sapiens
CTPIRDVLKREDTRKQACTQTRHHASPRPLAPAPGALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806805 - protein, 860 aa, Homo sapiens
YFCLLLSDAARVPEEGRHAETGLHPDTTPCISSAPGSCSWHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806806 - protein, 641 aa, Homo sapiens
MSLWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806807 - protein, 665 aa, Homo sapiens
MRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806808 - protein, 720 aa, Homo sapiens
MVGQEAGDGAGLWIPRAEVRVWDSMQSTEPARGFQQDWRGLVDGVRNPACCWWRPRSRGSGRGKLRAELGGCDHHLGEGTGRPWLCQNKSTFHTLHPLRIPRPLPDCPSAPPDTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806809 - protein, 680 aa, Homo sapiens
YFCLLLSDAARVPEEGRHAETVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806810 - protein, 499 aa, Homo sapiens
TGQSSVLPCISVRHCGTTCNLLEEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806811 - protein, 670 aa, Homo sapiens; identical to SEQ ID NO: 806798

SEQ ID NO: 806812 - protein, 847 aa, Homo sapiens; identical to SEQ ID NO: 806794

SEQ ID NO: 806813 - protein, 442 aa, Homo sapiens
PTSPTAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806814 - protein, 448 aa, Homo sapiens
GTGPESLGSEEGRHAETDPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806815 - protein, 390 aa, Homo sapiens
YFCLLLSDAARVPEEGRHAETDPPKKVTTVIQNPMPIREGDTVTLSCNYNSSNPSVTRYEWKPHGAWEEPSLGVLKIQNVGWDNTTIACAACNSWCSWASPVALNVQYAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806816 - protein, 548 aa, Homo sapiens
GTGPESLGSEEGRHAETDPPKKVTTVIQNPMPIREGDTVTLSCNYNSSNPSVTRYEWKPHGAWEEPSLGVLKIQNVGWDNTTIACAACNSWCSWASPVALNVQCESLGKAGGSGRWPGWDEGMKATRPEPGPVSSTELRDRSLASGPRGGEAWGQQKGQGAERSAWDPCPPDAPRDVRVRKIKPLSEIHSGNSVSLQCDFSSSHPKEVQFFWEKNGRLLGKESQLNFDSISPEDAGSYSCWVNNSIGQTASKAWTLEVLCELRAGGWEWSREGTSGLPGSDFAPPPPARHADAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806817 - protein, 185 aa, Homo sapiens
GSLNALAEGPVVGLTIYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806818 - protein, 516 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSCCLCPSWDLLVIIFPSLLHLSGPLPLI

SEQ ID NO: 806819 - protein, 466 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 806820 - protein, 1753 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806821 - protein, 88 aa, Homo sapiens
MAAAAGGPCVRCGAGRMDRGGCEARCQSRAEAGRELEAGCGDSGRANPGWMDGHRDGRRLRPNGPRARGSEESSSGGGPALHPFPPRS

SEQ ID NO: 806822 - protein, 1742 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806823 - protein, 870 aa, Homo sapiens
MSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806824 - protein, 799 aa, Homo sapiens
MWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806825 - protein, 757 aa, Homo sapiens
MISNIYFLFRPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806826 - protein, 1753 aa, Homo sapiens; identical to SEQ ID NO: 806820

SEQ ID NO: 806827 - protein, 1573 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSFSRSSARRWQPCATSPQMSARFCWISPWTLLNTTSCLP

SEQ ID NO: 806828 - protein, 1753 aa, Homo sapiens; identical to SEQ ID NO: 806820

SEQ ID NO: 806829 - protein, 1804 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQVGGQPEGRRERPCLPGWVLTIPEAVICLRALPTLGRAGAGSISFPVFPSSQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806830 - protein, 1535 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVGAQDGVLESGVMLGDREAVRSHWGTPSELQDVPERGLFPWGAQGLLSCAYSG

SEQ ID NO: 806831 - protein, 419 aa, Homo sapiens
HEDLLLPPYTHVASRLMQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806832 - protein, 247 aa, Homo sapiens
MVRGWVVLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806833 - protein, 197 aa, Homo sapiens
RPPKREPRSLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 806834 - protein, 1288 aa, Homo sapiens
RASGRAKMAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKSILSRELGSVDEILGPLTEILEGVLQADQQLMEKTKAKVFSAFITVLQMKEMKVSDIPQYSQLVLNVCETLQEEVIALFDQTRHSLALGSATEDKDSMETDDCPHAADAP

SEQ ID NO: 806835 - protein, 1288 aa, Homo sapiens; identical to SEQ ID NO: 806834

SEQ ID NO: 806836 - protein, 1197 aa, Homo sapiens
RASGRAKMAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVSLNELAFAFGFMKHSGLSFLPGKEKKVKGSWGIEIPLDPFGRNP

SEQ ID NO: 806837 - protein, 1123 aa, Homo sapiens
RASGRAKMAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKRVLSPLEILTEGWGSGSWWPIHWVHGWKSQGRGENWFGTIHGRPVSCVPGQSTDGIYDCQKELL

SEQ ID NO: 806838 - protein, 1006 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTK

SEQ ID NO: 806839 - protein, 718 aa, Homo sapiens
RASGRAKMAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKVQSDFVHKGQKKKRSSLVR

SEQ ID NO: 806840 - protein, 579 aa, Homo sapiens
RASGRAKMAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVFGKKGIL

SEQ ID NO: 806841 - protein, 105 aa, Homo sapiens
REGGREGEHEGRRERRAAASEERMGVTWRAIGLVWLGDWAADKRIRSSLLCLSQVNLGYLCQACTSLLHSRKMLQHYLQVSVLCHEVLEYLTLASQAPPSFLDSP

SEQ ID NO: 806842 - protein, 43 aa, Homo sapiens
ALHTVQYGLLKILSKTLAALRHFTPDVCQILLDQVLPIICSAP

SEQ ID NO: 806843 - protein, 177 aa, Homo sapiens
METNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGTSSLIPGMPQQVPPSESAGQIDQNFKMPQEINYKEAFQHEVAHEMPPGSKSPF

SEQ ID NO: 806844 - protein, 177 aa, Homo sapiens; identical to SEQ ID NO: 806843

SEQ ID NO: 806845 - protein, 177 aa, Homo sapiens; identical to SEQ ID NO: 806843

SEQ ID NO: 806846 - protein, 150 aa, Homo sapiens
METNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPAPGNHHSFCLCDLDYSESSYDHRENHP

SEQ ID NO: 806847 - protein, 822 aa, Homo sapiens
RPGPRKEKWEEGGARRPAPSAAHGDDSRHIRDPPAVAAEAPAARAPAPAAVVTPPRLAVAPVPPAAPAAPAAGDMSNPGGRRNGPVKLRLTVLCAKNLVKKDFFRLPDPFAKVVVDGSGQCHSTDTVKNTLDPKWNQHYDLYIGKSDSVTISVWNHKKIHKKQGAGFLGCVRLLSNAINRLKDTGYQRLDLCKLGPNDNDTVRGQIVVSLQSRDRIGTGGQVVDCSRLFDNDLPDGWEERRTASGRIQYLNHITRTTQWERPTRPASEYSSPGRPLSCFVDENTPISGTNGATCGQSSDPRLAERRVRSQRHRNYMSRTHLHTPPDLPEGYEQRTTQQGQVYFLHTQTGVSTWHDPRVPRDLSNINCEELGPLPPGWEIRNTATGRVYFVDHNNRTTQFTDPRLSANLHLVLNRQNQLKDQQQQQVVSLCPDDTECLTVPRYKRDLVQKLKILRQELSQQQPQAGHCRIEVSREEIFEESYRQVMKMRPKDLWKRLMIKFRGEEGLDYGGVAREWLYLLSHEMLNPYYGLFQYSRDDIYTLQINPDSAVNPEHLSYFHFVGRIMGMAVFHGHYIDGGFTLPFYKQLLGKSITLDDMELVDPDLHNSLVWILENDITGVLDHTFCVEHNAYGEIIQHELKPNGKSIPVNEENKKEYVRLYVNWRFLRGIEAQFLALQKGFNEVIPQHLLKTFDEKELELIICGLGKIDVNDWKVNTRLKHCTPDSNIVKWFWKAVEFFDEERRARLLQFVTGSSRVPLQGFKALQGAAGPRLFTIHQIDACTNNLPKAHTCFNRIDIPPYESYEKLYEKLLTAIEETCGFAVE

SEQ ID NO: 806848 - protein, 822 aa, Homo sapiens; identical to SEQ ID NO: 806847

SEQ ID NO: 806849 - protein, 502 aa, Homo sapiens
MFLLSVFINFTEQRTTQQGQVYFLHTQTGVSTWHDPRVPRDLSNINCEELGPLPPGWEIRNTATGRVYFVDHNNRTTQFTDPRLSANLHLVLNRQNQLKDQQQQQVVSLCPDDTECLTVPRYKRDLVQKLKILRQELSQQQPQAGHCRIEVSREEIFEESYRQVMKMRPKDLWKRLMIKFRGEEGLDYGGVAREWLYLLSHEMLNPYYGLFQYSRDDIYTLQINPDSAVNPEHLSYFHFVGRIMGMAVFHGHYIDGGFTLPFYKQLLGKSITLDDMELVDPDLHNSLVWILENDITGVLDHTFCVEHNAYGEIIQHELKPNGKSIPVNEENKKEYVRLYVNWRFLRGIEAQFLALQKGFNEVIPQHLLKTFDEKELELIICGLGKIDVNDWKVNTRLKHCTPDSNIVKWFWKAVEFFDEERRARLLQFVTGSSRVPLQGFKALQGAAGPRLFTIHQIDACTNNLPKAHTCFNRIDIPPYESYEKLYEKLLTAIEETCGFAVE

SEQ ID NO: 806850 - protein, 300 aa, Homo sapiens [sequence omitted]

SEQ ID NO: 806851 - protein, 187 aa, Homo sapiens
RPGPRKEKWEEGGARRPAPSAAHGDDSRHIRDPPAVAAEAPAARAPAPAAVVTPPRLAVAPVPPAAPAAPAAGDMSNPGGRRNGPVKLRLTVLCAKNLVKKDFFRLPDPFAKVVVDGSGQCHSTDTVKNTLDPKWNQHYDLYIGKSDSVTISVWNHKKIHKKQGAGFLGCVRLLSNAINRLKDTGCE

SEQ ID NO: 806852 - protein, 212 aa, Homo sapiens
RPGPRKEKWEEGGARRPAPSAAHGDDSRHIRDPPAVAAEAPAARAPAPAAVVTPPRLAVAPVPPAAPAAPAAGDMSNPGGRRNGPVKLRLTVLCAKNLVKKDFFRLPDPFAKVVVDGSGQCHSTDTVKNTLDPKWNQHYDLYIGKSDSVTISVWNHKKIHKKQGAGFLGCVRLLSNAINRLKDTGYQRLDLCKLGPNDNDTVRGQIVGKCGI

SEQ ID NO: 806853 - protein, 167 aa, Homo sapiens
AYQKCILIFIGKHEGFSPKKSASQESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 806854 - protein, 378 aa, Homo sapiens
PSGPAVYRVKVSQLLREGRRRVLGERLPPLQVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 806855 - protein, 473 aa, Homo sapiens
GQAGPPCLKTTKPLRSPLAPQPLQDLDLAVPETARLDSSLHKARAQLLAKGRRHRPSRSRLRDSASSAEDGEGSDGPGGKVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEGHPASEGHQSQDAMILSQENFYHPTLAAEGGRQGSKQAVPSFSPWKDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 806856 - protein, 429 aa, Homo sapiens
SRFPSGIPVEESGGVLSKGTWRNEGEDLDLAVPETARLDSSLHKARAQLLAKGRRHRPSRSRLRDSASSAEDGEGSDGPGGKVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 806857 - protein, 200 aa, Homo sapiens
MGSRESVEGSGRSGGSPFLPFSWFTDSGKGSASSGSTTSPTCSPKHEGFSPKKSASQESTLSDDSTPPSSSPKIPSGPWQEAKCSYPYHTLSQSSDEFLDEPLPPVHHWTSQQVGQWLQSLNLEQYAAEFAARQVDGPQLLQLDGSKLKSLGLSNSHDRALVKRKLKEMAAAAEKERKAQEKAARQREKLRRREQEAKKS

SEQ ID NO: 806858 - protein, 364 aa, Homo sapiens
GQAGPPCLKTTKPLRSPLAPQPLQDLDLAVPETARLDSSLHKARAQLLAKGRRHRPSRSRLRDSASSAEDGEGSDGPGGKVTDGCGSPLHRLRSPLHSGPGSPAGGSFCLDPPGLRRSLDEDEPPPSPLTRYRPLHNAASHEGLAAASCSPPRSAPSSDSSPSFVRRHPRAEPHSEGHPASEGHQSQDAMILSQENFYHPTLAAEGGRQGSKQAVPSFSPWKDDSRDASPPEPASPTIGLDKKTRRKFLDLGVTLRRASTGKSRKEKGSNRLSMGSRESVEGSGRSGGSPFLPFSWFTDSGKGSASSGSTTSPTCSPKHEGFSPKKSASQESTLSDDSTPPSSSHWLRGHRPHQGGWTWALHLG

SEQ ID NO: 806859 - protein, 378 aa, Homo sapiens; identical to SEQ ID NO: 806854

SEQ ID NO: 806860 - protein, 80 aa, Homo sapiens
GRVGRPTRPETPRHDNMEASPRITVSDYYEMEYRLPPPSLTLLLLVNHKKIGILVVSPAHHRRSGNQKTATQRDRDAPLV

SEQ ID NO: 806861 - protein, 323 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 806862 - protein, 323 aa, Homo sapiens; identical to SEQ ID NO: 806861

SEQ ID NO: 806863 - protein, 329 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEVCFTPKMNSKLFLLYILV

SEQ ID NO: 806864 - protein, 329 aa, Homo sapiens; identical to SEQ ID NO: 806863

SEQ ID NO: 806865 - protein, 325 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEIAKLWHQSKVHTYH

SEQ ID NO: 806866 - protein, 144 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQTI

SEQ ID NO: 806867 - protein, 207 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKLFIRESDAEREQNLPVTVTRYNEKHEKLSKEV

SEQ ID NO: 806868 - protein, 270 aa, Homo sapiens
MTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 806869 - protein, 263 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIIPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 806870 - protein, 392 aa, Homo sapiens
GDISGGGTGVCTPRIARCSYVVAPIRAILHLGNRGSIESAITMLAQPDDVEFQNRDNWRTISTNDAERHCDYTYLQGLTVQTDIHFKNAEKSAMVHSRREVLPNDPVFLEPHEEMTLCKYYEKRLLEFCSVFKPAMPRSVVDGYDMLISKRWLYVNNESIMSMGDSHPDVMDEMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 806871 - protein, 46 aa, Homo sapiens
ITRILGEERGHGAERVWRRRKEERRDEVRGERCDAGPRTGVDIAAG

SEQ ID NO: 806872 - protein, 78 aa, Homo sapiens
ALICEQLCRNTLSTRQSDVVINKKKDEEGWGVMSARVSAAHGEDDDRSPCKDCQGQGLYHQSRYNPTLGLALVPVQRS

SEQ ID NO: 806873 - protein, 220 aa, Homo sapiens
QYSSYLSSCCKGMVTAMALSKSTNSHKNATEDLYEVDKLKEAVKEFIEPEIDESFKEDEEESKEDRKLQEENKERAEEQPSTSTEKEKLIRFIGEDENVHSKPLFETDVLSSWRESAKQGTLAQKYLEAMAVIEHMQEKLLEVENRARQAEEKFEDAYEKLHHTLIKNKDLEELVMTSRKESKEEKENQDEREVKEEEEQQEEEEVRSAENSSKSPKKGH

SEQ ID NO: 806874 - protein, 102 aa, Homo sapiens [sequence omitted]

SEQ ID NO: 806875 - protein, 907 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 806876 - protein, 248 aa, Homo sapiens
MEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 806877 - protein, 258 aa, Homo sapiens
MPEELPRWSTMEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 806878 - protein, 128 aa, Homo sapiens
MSFSVPAPVSSSCPPEPSLGSPPEFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 806879 - protein, 112 aa, Homo sapiens
MCMCMDFLSPLGIRRLPQVGGLGESQGTWHQDAEPLALIPPTPKQVDGETMEGGGCTQLPGLKPIFSLCPQLTREFFTKELTKHYQGNNDTDVFSATWNSVMITVSDAPEML

SEQ ID NO: 806880 - protein, 83 aa, Homo sapiens
VSLAHGPLHSLGELEKQQGTKTLSFKPCGAQGDPQSKQGSPTAKREAALRERPAESTVEVLINASPARLTILPISRDTIKSYC

SEQ ID NO: 806881 - protein, 914 aa, Homo sapiens
SPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAGASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVSIHNRLQTSQHNSGLGAERGAPVPPPDLQPSPPRQQTPPLPPPPPTPPGTLVQCQQIVKVIVLDKPCLARMEPLLSQALSCYTSSSSDSCGSTPLGGPGSPVKVTHQPPLPPPPPPYNHPHQFCPPGSLLHGHRYSSGSRSLV

SEQ ID NO: 806882 - protein, 914 aa, Homo sapiens; identical to SEQ ID NO: 806881

SEQ ID NO: 806883 - protein, 914 aa, Homo sapiens; identical to SEQ ID NO: 806881

SEQ ID NO: 806884 - protein, 914 aa, Homo sapiens; identical to SEQ ID NO: 806881

SEQ ID NO: 806885 - protein, 884 aa, Homo sapiens
SPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAGASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVSIHNRLQTSQHNSGLGAERGAPVPPPDLQPSPPRQQTPPLPPPPPTPPGTLVQCQQIVKVIVLDKPCLARMEPLLSQALSCYTRLHRCLDPALRLRAPVPPVPTARQESLCTH

SEQ ID NO: 806886 - protein, 914 aa, Homo sapiens; identical to SEQ ID NO: 806881

SEQ ID NO: 806887 - protein, 794 aa, Homo sapiens
SPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAGASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVLINASPARLTILPISRDTIKSYC

SEQ ID NO: 806888 - protein, 1035 aa, Homo sapiens
MVVFVGRRLPALLGLFKKKGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 806889 - protein, 1094 aa, Homo sapiens
MAARAPPAAPAAEEPGNPGGPPRRKKSRSGASGLRRAFSWLRGKRRKKKAAGAEGAEPAAPRAKKAEDKAKRAKGKGRGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 806890 - protein, 1046 aa, Homo sapiens
MGNSHHKRKAPSGPRVRSFWRFGRSAKRPAGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 806891 - protein, 169 aa, Homo sapiens
GRATASPVPCLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 806892 - protein, 1094 aa, Homo sapiens; identical to SEQ ID NO: 806889

SEQ ID NO: 806893 - protein, 1094 aa, Homo sapiens; identical to SEQ ID NO: 806889

SEQ ID NO: 806894 - protein, 61 aa, Homo sapiens
QDGFSHRRSLPSSLGVDGSHGRICLTQGSRPLFPEIISPGPLERSFPPQLPRSRGNPADRA

SEQ ID NO: 806895 - protein, 67 aa, Homo sapiens
FQGFLIPVHNKFTSLLTNTEKSPDLSQYGSNQSSDLEGEEGYQILISFNTSMLRIRMIETVSFYETI

SEQ ID NO: 806896 - protein, 1004 aa, Homo sapiens
MGELCRRDSALTALDEETLWEMMESHRHRIVRCICPSRLTPYLRQAKVLCQLDEEEVLHSPRLTNSAMRAGHLLDLLKTRGKNGAIAFLESLKFHNPDVYTLVTGLQPDVDFSNFSGLMETSKLTECLAGAIGSLQEELNQEKGQKEVLLRRCQQLQEHLGLAETRAEGLHQLEADHSRMKREVSAHFHEVLRLKDEMLSLSLHYSNALQEKELAASRCRSLQEELYLLKQELQRANMVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVDYEASEPLFKAVLEDTTLEEAVGLLRRVDGFCCLSVKVNTDGYKRLLQDLEAKVATSGDSFYIRVNLAMEGRAKGELQVHCNEVLHVTDTMFQGCGCWHAHRVNSYTMKDTAAHGTIPNYSRAQQQLIALIQDMTQQCTVTRKPSSGGPQKLVRIVSMDKAKASPLRLSFDRGQLDPSRMEGSSTCFWAESCLTLVPYTLVWPHRPARPRPVLLVPRAVGKILSEKLCLLQGFKKCLAEYLSQEEYEAWSQRGDIIQEGEVSGGRCWVTRHAVESLMEKNTHALLDVQLDSVCTLHRMDIFPIVIHVSVNEKMAKKLKKGLQRLGTSEEQLLEAARQEEGDLDRAPCLYSSLAPDGWSDLDGLLSCVRQAIADEQKKVVWTEQSPR

SEQ ID NO: 806897 - protein, 434 aa, Homo sapiens
MVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVSRARPLLSPGLLMGTVAAGGVTQADFTSPRRCRSTLGWASALSWADVKRSAHL

SEQ ID NO: 806898 - protein, 1004 aa, Homo sapiens; identical to SEQ ID NO: 806896

SEQ ID NO: 806899 - protein, 236 aa, Homo sapiens
MEGRAKGELQVHCNEVLHVTDTMFQGCGCWHAHRVNSYTMKDTAAHGTIPNYSRAQQQLIALIQDMTQQCTVTRKPSSGGPQKLVRIVSMDKAKASPLRLSFDRGQLDPSRMEGSSTCFWAESCLTLVPYTLVWPHRPARPRPVLLVPRAVGKILSEKLCLLQGFKKCLAEYLSQEEYEAWSQRGDIIQEGEVSGGRCWVTRHAVESLMEKVRSKGGVGRGAVLGRVSGMQRRGMR

SEQ ID NO: 806900 - protein, 720 aa, Homo sapiens
MPPAPDQGRSCFHRPSCRLPTAQLYLLKQELQRANMVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVDYEASEPLFKAVLEDTTLEEAVGLLRRVDGFCCLSVKVNTDGYKRLLQDLEAKVATSGDSFYIRVNLAMEGRAKGELQVHCNEVLHVTDTMFQGCGCWHAHRVNSYTMKDTAAHGTIPNYSRAQQQLIALIQDMTQQCTVTRKPSSGGPQKLVRIVSMDKAKASPLRLSFDRGQLDPSRMEGSSTCFWAESCLTLVPYTLVWPHRPARPRPVLLVPRAVGKILSEKLCLLQGFKKCLAEYLSQEEYEAWSQRGDIIQEGEVSGGRCWVTRHAVESLMEKVRSKGGVGRGAVLGRVSGMQRRGMR

SEQ ID NO: 806901 - protein, 250 aa, Homo sapiens
MEGRAKGELQVHCNEVLHVTDTMFQGCGCWHAHRVNSYTMKDTAAHGTIPNYSRAQQQLIALIQDMTQQCTVTRKPSSGGPQKLVRIVSMDKAKASPLRLSFDRGQLDPSRMEGSSTCFWAESCLTLVPYTLVWPHRPARPRPVLLVPRAVGKILSEKLCLLQGFKKCLAEYLSQEEYEAWSQRGDIIQEGEVSGGRCWVTRHAVESLMEKNTHALLDVQLDSVCTLHRMDIFPIVIHVSVNEKMAKKLK

SEQ ID NO: 806902 - protein, 105 aa, Homo sapiens
EGNPTCLSSAPLQTRAGSAAPAQPAGSCTSADTPQAVLRASAPLHHSQVALVPIISPEFPFLLMASTAPPHPFSVPPLAIFWGTTEAGPHRQYGQSQGQPSAFVL

SEQ ID NO: 806903 - protein, 145 aa, Homo sapiens
ERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKVSKHIKVIKHIYENI

SEQ ID NO: 806904 - protein, 63 aa, Homo sapiens
MKEQEQYIATQYKEAIDLGQELRLTREQVQNSHTELAEARHQQVQAQREIERLSSELEDMKQL

SEQ ID NO: 806905 - protein, 97 aa, Homo sapiens
FINFTDTAYLFKIQIESLNDKLQNAKEQLREKEFIMLQNEQEISQLKKEIERTQQRMKEMESVMKEQEQYIATQYKEAIDLGQELRLTREQVQNSHT

SEQ ID NO: 806906 - protein, 74 aa, Homo sapiens
EKSGEYRASPRVPSTWERGRPVPPGTWLFPQSEAFPGSVKAAQVSSSKLPTIKYADPSFEEESEIIWRSVGVSF

SEQ ID NO: 806907 - protein, 214 aa, Homo sapiens
ERPSWGRSSAWRGCPTYRRPRSRRLALLYPPDQLHQHLCHLRNLLGLLLGLLAPLGRPALGRVARVLEVVEGALLRGLHLRFDLDEHIVHLPQLAPVPQRSHGQATYAQSNGEQNGVPAVNQRSARCGPFHDTAGPLYGQGGELRARARLEREAPAAASRPHGRARRHAQVKGHITVLTTAELRIQRNGFILLPRLECSSMITAYCSLDLPRFR

SEQ ID NO: 806908 - protein, 180 aa, Homo sapiens
SGQAGAAPRPGAGARLTADRAHDDSLFSIRRTSSTSISAIFAISLAFSSAFSHLLAARPSAASPGFWRWLRALSSEASTCVLIWMSILSISHSLLRFRRYARPCSRVSDAMSSRISLMTGSRNCSKSSSGSSTSTSSGSASSTMSRGRISSHCLGTAIAMSVGERKPTLAMLSNREPEYS

SEQ ID NO: 806909 - protein, 114 aa, Homo sapiens
GDPTGFGPLRMDSAACAAAATPVPALALALAPDLAQAPLALPGLLSPSCLLSSGQEVNGSERLFWPKSRSFDYLYSAGEILLQNFPVQATINLYEDSDSEEEEEDEEQEDEEEK

SEQ ID NO: 806910 - protein, 161 aa, Homo sapiens
GDPTGFGPLRMDSAACAAAATPVPALALALAPDLAQAPLALPGLLSPSCLLSSGQEVNGSERGTCLWRPWLSSTNDSPRQMRKLVDLAAGGATAAEVTKAESKFHHPVRLFWPKSRSFDYLYSAGEILLQNFPVQATINLYEDSDSEEEEEDEEQEDEEEK

SEQ ID NO: 806911 - protein, 67 aa, Homo sapiens
SSLSSTRAPPAAPWEEGDSLDQAEAQPQKSAFSRPGIRSVSDAGTSLFGSEVSARRTHGSFWSYAWL

SEQ ID NO: 806912 - protein, 239 aa, Homo sapiens
EAGCSPPACSVWAGVGASFQLGRSWFVVRLWGLLCPGLAWLCVREFLFRSAALFPGRSREARRRQRGPRPGASAPGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVSLVLLPPCTGINNLLTTLIHVLAFNG
